United States Patent 12,435,323 (ENZYMES WITH RUVC DOMAINS) - sequence listing, part 2

SEQ ID NO: 1758 - protein, 1371 aa, unidentified
  REGION 1..1371: note = Description of Unknown:uncultivated organism with predicted taxonomy: Clostridiales
  REGION 1..1371: note = MG23-4 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNPEGYDKMFRVMEPGNYSAYIGSVNSKESGKVRRNEGKGRSREDLYKTIRKLLGQCPQDDQDVALILSKIESETFLPKQLTADNGVIPNQVYAKEMRKILKNAATYLPFLKEKDESQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYLELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMSREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAIIQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYWVKGKSVLSLEAIPGYLGNAEHISDETLLRYLQDSLEKENPGKVISDLQIKYRCIRYKSLLKIDGFYYYIVGKTGKRIYLESAVPLILNNEDAIYLKKIEKAVSGQYFEEKREGQLIITEERNQKLYDILLEKLTDGIYRNKKASLQTILQEGREKFIRLSIPNQCQILMNLVEWFQLSCVTADMKEIGGSANSGKCLMGKKISDCSEMILITQSATGLQERRIDLLKL

SEQ ID NO: 1759 - protein, 1385 aa, unidentified
  REGION 1..1385: note = Description of Unknown:uncultivated organism with predicted taxonomy: Firmicutes
  REGION 1..1385: note = MG23-5 effector
MDKVKQAPYYIGLDMGTSSVGWAVTDEDYKILRGKGKDMWGVRLFDEAKTAAERRTFRVARRRRQREVARIGLLREYFADAIHEVDPGFFHRLEESKYYLEDRDDDNQQKFALFNDKNFTDKEYYAQYPTIFHLRKELIESSDPHDVRFVFLAILNLFKRRGHFLNKGLSADGGESSMAEAYETLVEEARNQEIILPEALDTQALEACLGEKGLSRSTIKENVMELLAVSKKDKAATELISMMCGLMGTLQKIYGSDLIDDEHKGMKISFRAMNYEEEAAEIVALIGEDNFALLEAVKEVHDIGLLAHILEGEQYLSMARVKQYDAHHEDLLQLKRVLKKYDKDEYDKMFRMMGQDNYSAYVGSVNYNENKVRRNGGKGKDVEAFYKNVKKVMDKLPEIAQNDPDVKDIRTKIEGEAFLQKQLTASNGIIPNQVHTRELKAILENASGYLPFLNEKDDSGLTVKERILELYSFQIPYYVGPLGQQHEGEKGYNVWAKRRPGEAKGRILPWNFEQKIDVNQAAEDFIKRMVRHCTYLKGENTLPKQSLLYEKFMVLNELNNLRIRGEKPSVEVKQEIYETLFMTGKRVTRKQLLKYLVANGLLNEDDGDMVSGIDQDFKASLSSLNKFKGVLGDAAVYDSNRAMIEQIIFWATIYGDDKHFLKNRIKEHYGDSLDNQQIKRICGMKFNGWGNLSKTFLELQGASKEDGVYRSIIQSLWETNDNLMQLLSERYTYSEELEKMIGDAEKPLSEWKIEDLDDMYLSPSVKRMVWQTLKILNEIVEVRGYAPDKIFVEMARDSAQTRARNKGKRTQSRKEFLLNVYKEDKEWRKEIQSCEEIKFRKKKIYLYYLQHGKSLYSGKTIDFDTLLSDNDAYDIDHIYPRHFVKDDSLENNLVLCLKSENAKKGDQYPLRKTFDSAVLSSQEGVWKSLLKQKVITKEKYDRLVRTADFTIDELAGFINRQLVETRQGTKAITQILKRVFKNEAVEIIFTKAELISDFRRIFDLPKVRCVNSTHHAHDAYLNIVVGNVYNAKFTKHPRHFIEECQRKGSYDYNMYRMFDYDVKCGSKIVWCGSKITTCGKGTISTVKKQLQKRSVLLTKKSFMKHGKLFAANNTGKESIKSDAYYSDKTTDIRLLDVQKYGGKSDISNTAFALVEFYSKGKPVRILERIPLYLNITNNNDENLNNYISKKIKKDLKNVEISEMSIRMYPIRQYVKLKINGYFYYLSGSDDDTRVSLRDAVTFYLSDEEMAYVKYIEKAVETQNFYRQKNKKAVLSEAGNIKLYEVLIEKLQQGIFLKKKISIVPVLLEGKEKFKALPLEKQCYIIMQIFAWITSNQQGVNLKDIGGASNAGKLKMSKNISDLSEAILIEQSATGLYERRIDLLTV

SEQ ID NO: 1760 - protein, 1382 aa, unidentified
  REGION 1..1382: note = Description of Unknown:uncultivated organism with predicted taxonomy: Clostridiales
  REGION 1..1382: note = MG23-6 effector
MDKVKQAPYYIGLDMGTSSVGWAVTDEDYKILRGKGKDMWGVRLFDEAKTAAERRTFRVARRRRQREVARIGLLREYFADAIHEVDPGFFHRLEESKYYLEDRDDDNQQKFALFNDKNFTDKEYYAQYPTIFHLRKELIESSDPHDVRFVFLAILNLFKRRGHFLNKGLSADGGESSMAEAYETLVEEARNQEIILPEALDTQALEACLGEKGLSRSTIKENVMELLVVSKKDKAATELISMMCGLKGTLQKIYGSDLIDDEHKGMKISFRDMNYEEEAAEIVALIGEDNFALLEAVKEVHDIGLLAHILEGEQYLSMARVKQYDAHHEDLLQLKRVLKKYDKDEYDKMFRMMGQDNYSAYVGSVNYNENKVRRNGGKGKDVEAFYKNVKKVMDKLPEIAQNDPDVKDIRTKIEGEAFLQKQLTASNGIIPNQVHTRELKAILEKASGYLPFLNEKDDSGLTVKERILELYSFQIPYYVGPLGQQHAGEKGYNVWAKRRPGEAKGRILPWNFEQKIDVNQAAEDFIKRMVRHCTYLKGENTLPKQSLLYEKFMVLNELNNLRIRGEKPSVEVKQDIYETLFMTGKRVTRKQLLKYLAANGLLNEDDGDMVSGIDQDFKASLSSLNKFKGVLGDAAVYDSNRAMIEQIIFWATIYGDDKHFLKNRIKEHYGDSLDDQQIKRICGMKFNGWGNLSKTFLELQGASKEDGVYRSIIQSLWETNDNLMQLMSERYTYTEKLEKMVGDAEKPLSEWKIEDLDDLYLSPSVKRMVWQTLKILNEIVEVRGYAPDKIFVEMARDSAQTRARNKGKRTQSRKDFLINAYKEDKEWRKEIESRDEAEFRIKKLYLYYVQMGRCMYSGEAIDLHALMAGNEQYDIDHIYPRHFVKDDSLENNLVLVKKTINAHKSDTFPLEAELRKKQYAFWRSLLDRGLITQNKFNRLTRATGFSNEELAGFINRQLVETRQGTKAITQILKEAFKNDDTRIVFTKAEVTADFRHKYDLPKARSVNNLHHAHDAYLNIVAGNVYDAKFTSHPINFIKECRNKGVFNYNMAKVFDYNVKRGNRYVWIAQNDGMDMPLTIERVKNQLARNTILMTRRSYMAHGGISNKATIYGKDTAKPGSYLPVKSSDSRLSDVTKYGGITSVLNTAYALVEYKVKGKMVRSLESVPLYVDATGKDDEKLLNYLRESLQFENKKNLVENVSVRLYPVRQRSLLKLDGYYYHLGGGAGSMFYLIDAVPMYLPQKVVMYIKKIEKAMETQRYDEINSKNEVIITKENNAETYDLLLHKLTKGIYSHRKASIINILVNGEEKFDSLNLEAQCSVILKIFAWINSSQQTVDLKDIGGSANSGFLKTSRKLSNSTEAILIEQSATGLYERRIDLLTV

SEQ ID NO: 1761 - protein, 1371 aa, unidentified; identical to SEQ ID NO: 1758
  REGION 1..1371: note = Description of Unknown:uncultivated organism with predicted taxonomy: Clostridiales
  REGION 1..1371: note = MG23-7 effector

SEQ ID NO: 1762 - protein, 1371 aa, unidentified
  REGION 1..1371: note = Description of Unknown:uncultivated organism with predicted taxonomy: Clostridiales
  REGION 1..1371: note = MG23-8 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNQEGYDKMFRVMEPGNYSAYIGSVNSKESGKVRRNEGKGRSREDLYKTIRKLLGQCPQDDQDVALILSKIESETFLPKQLTADNGVIPNQVYVKEMRKILKNAATYLPFLKEKDESQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYSELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMPREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYRVKGKSVLSLEAIPGYLGNAENISDETLLRYLQDSLEKENPGKVISDLQIKYRCIRYKSLLKIDGFYYYIVGKTGKQIYLESAVPLILNNEDAIYLKKIEKAVSGQYFEEKREGQLIITEECNQKLYDILLEKLTDGIYRNKKASLQTILQEGREKFIRLSIPNQCQILMNLVGWFQLSCVTADMKEIGGSVNSGKCLMGKKISDCSEMILITQSATGLQERRIDLLKL

SEQ ID NO: 1763 - protein, 1371 aa, unidentified
  REGION 1..1371: note = Description of Unknown:uncultivated organism with predicted taxonomy: Clostridiales
  REGION 1..1371: note = MG23-9 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNPEGYDKMFRVMEPGNYSAYIGSVNSKESGKVRRNEGKGRSREDLYKTIRKLLGQCPQDDQDVALILSKIESETFLPKQLTADNGVIPNQVYAKEMRKILKNAATYLPFLKEKDEFQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYSELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMSREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYRVKGKSVLSLEAIPGYLGNAENISDETLLRYLQDSLEKENPGKVISDLQIKYRCIRYKSLLKIDGFYYYIVGKTGKRICLESAVPLILNNEDAIYLKKIEKAVSGQYFEEKREGQLIITEECNQKLYDILLEKLTDGIYRNKKASLQTILQEGREKFIRLSIPNQCQILMNLVGWFQLSCVTADMKEIGGSVNSGKCLMGKKISDCSEMILITQSATGLQERCIDLLKL

SEQ ID NO: 1764 - protein, 1389 aa, unidentified
  REGION 1..1389: note = Description of Unknown:uncultivated organism with predicted taxonomy: Clostridiales
  REGION 1..1389: note = MG23-10 effector
MEINLENNAEEIIMGKKMYIGIDMGTSSVGMAVTDENYTLYRVKGKDFWTSRLFKEANTAAERRTNRVARRRRQRETARMGILRELFSEEINKVDEGFFARLDESKYHIEDRVVKQKYALFADKGYTDKEYYKEYPTIFHLRNELLHPQKNSYDVRLVYLAIANMFKHRGNFLNETLDIDKITANAVDVYSQLVEELDLYCIQMPVSIDIGKLMNIIGENGISRSKRLENASKYLGITKKDKQSYEILKLICGLKGILYNIYGENVIDEENKKFSLSFTGSIYEDSEAQAKDILGDEYFELIEIIKELHDICVLSGIIKGHKFLSEARVELYEEHKKDLDMLQQVLKKYDKNAYDEMFRVMKEGNYSAYVGSVNARGKNKKIRRNVGEGKKGKNGRSQETFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKRDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNETCELTGRLPDKIFVEMPREHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITGERNMKFFNTLGSKLNARPYNNNRWNIYKIMENKEEIFAGLSIEKQCYVINQIISWINSKTQNVDLSDIKGSSHSGTMPLNKKISECSQFELIYQSVTGMYEKRTDLLKL

SEQ ID NO: 1765 - protein, 1368 aa, unidentified
  REGION 1..1368: note = Description of Unknown:uncultivated organism with predicted taxonomy: Butyrivibriosp. CAG:318
  REGION 1..1368: note = MG23-11 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1766 - protein, 1109 aa, unidentified
  REGION 1..1109: note = Description of Unknown:uncultivated organism with predicted taxonomy: Butyrivibriosp. CAG:318
  REGION 1..1109: note = MG23-12 effector
LCLERSERNDKNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1767 - protein, 1389 aa, unidentified
  REGION 1..1389: note = Description of Unknown:uncultivated organism with predicted taxonomy: Clostridium sp.AF36-4
  REGION 1..1389: note = MG23-13 effector
MEINLENNAEEIIMGKKMYIGIDMGTSSVGMAVTDENYNLYRVKGKDFWTSRLFKEANTAVERRTNRVSRRRRQRETARMGILRELFSEEINKVDEGFFARLDESKYHIEDRDVKQKYALFADKGYTDKEYYKEYPTIFHLRNELLHPQKDSYDVRLVYLAIANMFKHRGNFLNETLDIDKITASADDVYSQLIEELDLYCIQMPVNINIGELINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKMLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVHGALSNKVTVWSSKSAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1768 - protein, 1368 aa, unidentified
  REGION 1..1368: note = Description of Unknown:uncultivated organism with predicted taxonomy: Butyrivibriosp. CAG:318
  REGION 1..1368: note = MG23-14 effector
MDKKMYVGIDMGTNSVGMAVTDEEYNLYRVKGKDLWCSRLFTEADTAAERRTNRISRRRRQREVARMGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADETYQQLIEMAMMYSIEFPKNINVEKFIDIIGENGVSRSKHLENVCEYLGITKKDKPAYEILNLVCGLRGVLINIYGNEVIDEENKKFSICFRDSNYEEKEGEALELLGDEYFELLETIKEIHDIGMLAGIIKGHKYISEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHASELKAILTNAEKYLPFLLGKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLKIDGKKPSVQVKQGIYEELFKTGKRVTLKQLKKYLYNNSIIASEENVVIEGIDGGFNSSLTSVGKFRGVLGDELFTDANQAMAEEIIFWGTVYGNDKKFLKDEIESKYGTVLSKDQIKRILGFKFNGWGNLSKTCLELQGSCECGDCSLIQALWETNHNLMELLSEQYGFKKELDALACNVEKPLTEWTIDDLDNKYLSAPVKRMVWQTIKMLREVCELTNKEPDRVFVEMPREHGKENDRKTSRKKKILDLYSALKREKKEWAELKIREIEGRTEADFRIKKLYLYYLQQGRCMYSGEKIELNDLFNNNLYDIDHIYPRHFIKDDSLENNLVLVKKEINNHKSDNYPLESDIRKNMNEFWKSLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLIEYKVKGKKVRSLEALPVYLGRSNTLTDEDIMQYISNVLQKEYAGKEISDLSVRVPFVPQKSKVRVDGFEYYLGGKTGNYICLNNAMPLYLSGNDEEYLRKIMKAIEIDNYEEIDKDSNAIITEEKNAALFNTLSVKLNSEPYINNQWNIYKILEGKEEIFKDLDIQKQCYVIVKIIDWIKSKTQGVDLTDIQGKNQSGTMKVNKRISECKECILIHQSVTGMYERRIDLLSI

SEQ ID NO: 1769 - protein, 1366 aa, unidentified
  REGION 1..1366: note = Description of Unknown:uncultivated organism with predicted taxonomy: Butyrivibriosp. CAG:318
  REGION 1..1366: note = MG23-15 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKESYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKIPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSLLYEKFMVLNELNNLKIAGKKPSVQVKQDIYEKLFKPGKKVTLKQLQEYLCNNSIIASKEDIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGNCSLIQALWETNHNLMELLSEQYGFKKELDALACNVEKPLTEWTIDDLDNKYLSAPVKRMVWQTIKMLREVCELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDVYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTEKNIYLNNTMPLYLSWNDEEYLRKIMKAIDIDSYEEIDKDGNAIITEEKNVALFGALSVKLNSEPYINNRWNIYKILDGKEEIFKNLDIKKQCYVISQIIAWINSSTPNVNLKDVCGSEHSGMQRLNKKISECKECILIHQSVTGMYERRIDLLSI

SEQ ID NO: 1770 - protein, 1389 aa, unidentified; identical to SEQ ID NO: 1767
  REGION 1..1389: note = Description of Unknown:uncultivated organism with predicted taxonomy: Clostridium sp.AF36-4
  REGION 1..1389: note = MG23-16 effector

SEQ ID NO: 1771 - protein, 1366 aa, unidentified
  REGION 1..1366: note = Description of Unknown:uncultivated organism with predicted taxonomy: Butyrivibriosp. CAG:318
  REGION 1..1366: note = MG23-17 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSRDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1772 - protein, 1389 aa, unidentified
  REGION 1..1389: note = Description of Unknown:uncultivated organism with predicted taxonomy: Clostridiales
  REGION 1..1389: note = MG23-18 effector
MEINLENNAEEIIMGKKMYIGIDMGTSSVGMAVTDENYNLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1773 - protein, 1368 aa, unidentified; identical to SEQ ID NO: 1768
  REGION 1..1368: note = Description of Unknown:uncultivated organism with predicted taxonomy: Butyrivibriosp. CAG:318
  REGION 1..1368: note = MG23-19 effector

SEQ ID NO: 1774 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-20 effector

SEQ ID NO: 1775 - protein, 993 aa, unidentified
  REGION 1..993: note = Description of Unknown:uncultivated organism with predicted taxonomy: Butyrivibriosp. CAG:318
  REGION 1..993: note = MG23-21 effector
MDKKMYVGIDMGTNSVGMAVTDEEYNLYRVKGKDLWCSRLFTEADTAAERRTNRISRRRRQREVARQGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADESYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMRAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESDIRKNMNEFWKSLREKNFISKEKYSRLIRTEEFTDEEKAAFISRQLVETRQGTKAITQVLKQAFPNTQIVFVKAGIVSDFRKKFDINKVRALND

SEQ ID NO: 1776 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-22 effector

SEQ ID NO: 1777 - protein, 1366 aa, unidentified
  REGION 1..1366: note = Description of Unknown:uncultivated organism with predicted taxonomy: Butyrivibriosp. CAG:318
  REGION 1..1366: note = MG23-23 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1778 - protein, 1383 aa, unidentified
  REGION 1..1383: note = Description of Unknown:uncultivated organism with predicted taxonomy: Clostridiales
  REGION 1..1383: note = MG23-24 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDICVLSGIIKGHKFLSEARVELYEEHKNDLDMLQQVLKKYDKNAYDEMFRVMKEGNYSAYVGSVNACGKNKKIRRNGGKGRSQEDFYKYVKTTLKNYPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1779 - protein, 1368 aa, unidentified
  REGION 1..1368: note = Description of Unknown:uncultivated organism with predicted taxonomy: Butyrivibriosp. CAG:318
  REGION 1..1368: note = MG23-25 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKESYDVRLVYLAIANMFKHRGNFLNESLDADKITSSADEAYRSLVETAMMYSIEVPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFQEDDEEIKTILSEIDSETFMPKQLTASNGVIPNQLHVSELKAILTNAEEYLPFLLGKDESGLTVSERIVELFRFHIPYYVGPIGAQGENVWAKRRPGEENGKVYPWNFEQKIDIQSAAKEFINRMVRHCTYLSGERTLPKQSFLYEKFMVLNELNNLKIDGKKPSVQVKQGIYEELFKTGKRVTLNRLKDYLYNNSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1780 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-26 effector

SEQ ID NO: 1781 - protein, 829 aa, unidentified
  REGION 1..829: note = Description of Unknown:uncultivated organism with predicted taxonomy: Butyrivibriosp. CAG:318
  REGION 1..829: note = MG23-27 effector
MVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1782 - protein, 1366 aa, unidentified; identical to SEQ ID NO: 1777
  REGION 1..1366: note = Description of Unknown:uncultivated organism with predicted taxonomy: Butyrivibriosp. CAG:318
  REGION 1..1366: note = MG23-28 effector

SEQ ID NO: 1783 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-29 effector

SEQ ID NO: 1784 - protein, 1366 aa, unidentified
  REGION 1..1366: note = Description of Unknown:uncultivated organism with predicted taxonomy: Butyrivibriosp. CAG:318
  REGION 1..1366: note = MG23-30 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGNCSLIQALWETNHNLMELLSEQYGFKKELDALACNVEKPLTEWTIDDLDNKYLSAPVKRMVWQTIKMLREVCELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDVYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTEKNIYLNNTMPLYLSWNDEEYLRKIMKAIDIDSYEEIDKDGNAIITEEKNVALFGALSVKLNSEPYINNRWNIYKILDGKEEIFKNLDIKKQCYVISQIIAWINSSTPNVNLKDVCGSEHSGMQRLNKKISECKECILIHQSVTGMYERRIDLLSI

SEQ ID NO: 1785 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-31 effector

SEQ ID NO: 1786 - protein, 1366 aa, unidentified
  REGION 1..1366: note = Description of Unknown:uncultivated organism with predicted taxonomy: Butyrivibriosp. CAG:318
  REGION 1..1366: note = MG23-32 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1787 - protein, 1389 aa, unidentified
  REGION 1..1389: note = Description of Unknown:uncultivated organism with predicted taxonomy: Clostridiales
  REGION 1..1389: note = MG23-33 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSLIDSKEVMITGIDGGFKSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITSERNMKFFNTLSSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1788 - protein, 1368 aa, unidentified
  REGION 1..1368: note = Description of Unknown:uncultivated organism with predicted taxonomy: Butyrivibriosp. CAG:318
  REGION 1..1368: note = MG23-34 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLVCGMSGVLINIYGDEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAQRRPGEEKGRVYPWNFEQKIDTQSAAKEFINRMVRHCTYLSGERTLPKQSFLYEKFMVLNELNNLRIDGKKPSVQVKQGIYEELFKTGKRVTLNKLKDYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGLCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAISQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTGNRICLNNAMSLYLSENDEEYLRKIMKAIEIDNYEEIDKDSNAIITEEKNVDLFDVLSVKLNSEPYINNRWNIYKTLDGKKEIFENLDIKKQCYVISQIIFWINSSTQSVNLKDVCGSEHSGMQPLNKKISECKECILIHQSVTGMYERRIDLLSI

SEQ ID NO: 1789 - protein, 1180 aa, unidentified
  REGION 1..1180: note = Description of Unknown:uncultivated organism with predicted taxonomy: Butyrivibriosp. CAG:318
  REGION 1..1180: note = MG23-35 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEEYLPFLLGKDESGLTVSERIVELFRFHIPYYVGPIGAQGENVWAQRRPGEEKGRVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDASKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYMSHV

SEQ ID NO: 1790 - protein, 1389 aa, unidentified
  REGION 1..1389: note = Description of Unknown:uncultivated organism with predicted taxonomy: Clostridiales
  REGION 1..1389: note = MG23-36 effector
MEINLENNAEEIIMGKKMYIGIDMGTSSVGMAVTDENYNLYRVKGKDFWTSRLFKEASTAANRRTNRVARRRRQRELARMGILRELFSEEINKVDEGFFARLDESKYHIEDRDVKQKYALFADKGYTDKEYYKEYPTIFHLRNELLHPQKDSYDVRLVYLAIANMFKHRGNFLNETLDIDKITANAVDVYSQLIEQLDLYCIQMPVSIDIGKLINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVIHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWSKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMDNKEEIFAGLSIEKQCYVINQIISWINSKTQNVDLSDIKGSSHSGTMTLNKKISDCSQFELIYQSVTGMYEKRTDLLKL

SEQ ID NO: 1791 - protein, 1389 aa, unidentified
  REGION 1..1389: note = Description of Unknown:uncultivated organism with predicted taxonomy: Clostridiales
  REGION 1..1389: note = MG23-37 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIDELDLYCIQMPVSIDIGKLINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILVEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKGTVWSSKLAKKNPDAYMPVKTTDEKACDVKKYGGITAIANSGYTLVEYNINGKMIRSIEALPVYLGRKNMLTDDKIREYLHEKIRKEYKNKTVTDLKVCILFIPQKSKVCVDGFNYYLGGVTGNSIYLSNAEPLYLSKEDEEYLRKIIKAVDKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1792 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-38 effector

SEQ ID NO: 1793 - protein, 1366 aa, unidentified; identical to SEQ ID NO: 1784
  REGION 1..1366: note = Description of Unknown:uncultivated organism with predicted taxonomy: Butyrivibriosp. CAG:318
  REGION 1..1366: note = MG23-39 effector

SEQ ID NO: 1794 - protein, 1366 aa, unidentified
  REGION 1..1366: note = Description of Unknown:uncultivated organism with predicted taxonomy: Butyrivibriosp. CAG:318
  REGION 1..1366: note = MG23-40 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEDIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1795 - protein, 958 aa, unidentified
  REGION 1..958: note = Description of Unknown:uncultivated organism with predicted taxonomy: Clostridiales
  REGION 1..958: note = MG23-41 effector
MPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTVKMLNETCELTGRVPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLYEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLGSKLNARPYNNNRRNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1796 - protein, 1366 aa, unidentified
  REGION 1..1366: note = Description of Unknown:uncultivated organism with predicted taxonomy: Butyrivibriosp. CAG:318
  REGION 1..1366: note = MG23-42 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1797 - protein, 1368 aa, unidentified
  REGION 1..1368: note = Description of Unknown:uncultivated organism with predicted taxonomy: Butyrivibriosp. CAG:318
  REGION 1..1368: note = MG23-43 effector
MDKKMYVGIDMGTNSVGMAVTDEEYNLYRVKGKDLWCSRLFTEADTATERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1798 - protein, 1366 aa, unidentified
  REGION 1..1366: note = Description of Unknown:uncultivated organism with predicted taxonomy: Butyrivibriosp. CAG:318
  REGION 1..1366: note = MG23-44 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKNRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1799 - protein, 1042 aa, unidentified
  REGION 1..1042: note = Description of Unknown:uncultivated organism with predicted taxonomy: Butyrivibriosp. CAG:318
  REGION 1..1042: note = MG23-45 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIF

SEQ ID NO: 1800 - protein, 1376 aa, unidentified
  REGION 1..1376: note = Description of Unknown:uncultivated organism with predicted taxonomy: Clostridiales
  REGION 1..1376: note = MG23-46 effector
MGKNMYIGVDMGTSSDGVAVTDENYTLYRVKGKDLWTSRLFKEANTAAERRTNRVSRRRRQRETARMGILRELFSEEINKVDEGFFARLDESKYHIEDRVVKQKYALFVDKGYTDKEYYKEYPTIFHLRNELLHPQKNSYDVRLVYLAVANMFKHRGNFLNETLDIDKITANAVDVYSQLIEELDLYCIQMPVSIDIGKLINIIGENGISRSKRLENASKYLGITKKDKQSYEILKLICGLKGILYNIYGENVIDEENKKFSLSFTDSNYEDEETQAKDILGDEYFELIEIIKELYDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNYPDDDENIKNILFKIENETFMPKQLTASNGIIPNQLHAAELKAILTNAEKYLPFLLDKDESDLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIKKDMSGFWKYLCEKKFITKEKYNRLMRTDKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKICILFIPQKSKVCVDGFNYYLGGVTGNSIYLSNAEPLYLSKEDEEYLRKIIKAVGKGYYEETDENGQIIITGERNMKFFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1801 - protein, 1366 aa, unidentified
  REGION 1..1366: note = Description of Unknown:uncultivated organism with predicted taxonomy: Butyrivibriosp. CAG:318
  REGION 1..1366: note = MG23-47 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1802 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-48 effector

SEQ ID NO: 1803 - protein, 993 aa, unidentified
  REGION 1..993: note = Description of Unknown:uncultivated organism with predicted taxonomy: Clostridiales
  REGION 1..993: note = MG23-49 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKCILYNIYGENVIDEENKKFSISFTDSNYEDEETQAKDILGDEYFELIEIIKELHDICVLSGIIKGHKFLSEARVELYEEHKNDLDMLQQVLKKYDKNAYDEMFRVMKEGNYSAYVGSVNARGKNKKIRRNGGKGRSQEDFYKYVKTTLKNYPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSD

SEQ ID NO: 1804 - protein, 1386 aa, unidentified
  REGION 1..1386: note = Description of Unknown:uncultivated organism with predicted taxonomy: Clostridiales
  REGION 1..1386: note = MG23-50 effector
MDRDDKKMYVGIDMGTNSVGLAVTDEKYNLYRVKGKDFWCSRIFSKAETAEVRRVNRISRRRRQRETARQGILREFFAEEINKVDEGFFARLDESKYHIEDRENQQKYTLFIDNGYTDKEYYAEYPTIFHLRNELLHPQKDSYDVRLVYLAISNMFKHRGNFLNETLDMGKVTSSAGDIYQQLVEEAMLYVIELPVSIDVERLINIIGEKGVSRSKHLENVSSYLGITKKDKSAYEILKLVCGMSGLLFNIYGEEIIDEENKKFSLNFRDTNYEEKEGQALELLGNDNFQLIEIIKELHDIGVLSSIIKGHKFLSESRVELYEEHKKDLDMLQAVLKRYDKKAYNDMFRIMKEGNYSAYVGSVNSIGQNEKRSEKCQKQKIRRNRGKGSSQEVFYKYVKSVLKKLPEDDKDVKKIMEKIENETFMPKQLTASNGVMPNQLHTVELRAILENAEKYLPFLLNKDESGLTVSQRIVELFKFHIPYYVGPIGAGGQNVWAKRRKGEEKGRIYPWNFEQKIDTQAAAEEFIGRMVRHCTYLANERTLPKQSLLYEKYMVLNELNNMKINGIKPDVSVKQGIYNDLFKKGKRVTLNALKSYLYNNSIIESKEDVVITGIDIVHNGGFSASLTSVGKFIGVLGDELFTDENQTMVEQIIFWGTVYGNDKKFLKNRIQETYAGRLTWEQIKRIAGFKFNGWGNLSKAFLELKGNCECGECSIIQALWETNHNLMELLADQYDFKKNLEAMSNNVEKPLQEWTIEDLEGKYLSAPVKRMVWQTVKMLREVCELTGRQPDKVFVEMPREEGIKNERKNSRKKKLLELYTSIKNEQKAWSEVKIREIDGRTETDFRIKKLYLYYLQHGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQLVETRQGTKAVTQILKQAFPDTQIIFVKAGVVSDFRKKFNINKVRALNDTHHAKDAYLNIVVGNIYNTKFTSNPINFIKDARKNVNDISYKYNMDKMFDYNVCRNGENAWIADNGKSKQHVLSVLGKNSVIITRKTEENHGALSNKVTVWSKDTAKKNPGAYMPVKTTDSKAQDVTKYGGITSIASSGYTLIEYKVKGKTIRSIEALPVYLGKSDTLTEERILEYIGVNLKKEYKDKEISDIKVCVKFIPFKSKIRIDGFNYYLGGKTGNYIYLNNDEALYLNNNDEEYLRKITKAIDITNYEEIDENGNVIITQEKNTKLFNVLCEKLNNKPYRYNRWNIYNVLEGKEETFRKLDVEKQCYIINQIILWVNSAVQNINLKYINGKEHEGSLHMNKKISEYDEAVLIQQSVTGMYERKTDLLKV

SEQ ID NO: 1805 - protein, 1389 aa, unidentified
  REGION 1..1389: note = Description of Unknown:uncultivated organism with predicted taxonomy: Clostridiales
  REGION 1..1389: note = MG23-51 effector
MEINLENNAEEIIMGKKMYIGIDMGTSSVGMAVTDENYTLYRVKGKDFWTSRLFKEANTAAERRTNRVARRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLIEYNINGKMIRSIEALPVYLGRKNMLTDDKIKEYLHEKIRKEYKNKTVTDLKVCILFIPQKSKVCVDGFNYYLGGVTGNSIYLSNAEPLYLSKEDEEYLRKIIKAVSKGYYEETDKNGQIIITDERNMKFFNTLGSKLNARPYCNNRWNIYKIMENKEEIFAGLSIEKQCYVINQIISWINSKTQNVDLSDIKGGSHSGTMTLNKKISECSQFELIYQSVTGMYEKRTDLLKL

SEQ ID NO: 1806 - protein, 1366 aa, unidentified
  REGION 1..1366: note = Description of Unknown:uncultivated organism with predicted taxonomy: Butyrivibriosp. CAG:318
  REGION 1..1366: note = MG23-52 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVFRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1807 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-53 effector

SEQ ID NO: 1808 - protein, 1366 aa, unidentified; identical to SEQ ID NO: 1777
  REGION 1..1366: note = Description of Unknown:uncultivated organism with predicted taxonomy: Butyrivibriosp. CAG:318
  REGION 1..1366: note = MG23-54 effector

SEQ ID NO: 1809 - protein, 1368 aa, unidentified; identical to SEQ ID NO: 1765
  REGION 1..1368: note = Description of Unknown:uncultivated organism with predicted taxonomy: Butyrivibriosp. CAG:318
  REGION 1..1368: note = MG23-55 effector

SEQ ID NO: 1810 - protein, 1114 aa, unidentified
  REGION 1..1114: note = Description of Unknown:uncultivated organism with predicted taxonomy: Butyrivibriosp. CAG:318
  REGION 1..1114: note = MG23-56 effector
FFITCLCLERSERNDKNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1811 - protein, 829 aa, unidentified; identical to SEQ ID NO: 1781
  REGION 1..829: note = Description of Unknown:uncultivated organism with predicted taxonomy: Butyrivibriosp. CAG:318
  REGION 1..829: note = MG23-57 effector

SEQ ID NO: 1812 - protein, 1366 aa, unidentified
  REGION 1..1366: note = Description of Unknown:uncultivated organism with predicted taxonomy: Butyrivibriosp. CAG:318
  REGION 1..1366: note = MG23-58 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSRDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGNAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1813 - protein, 1389 aa, unidentified
  REGION 1..1389: note = Description of Unknown:uncultivated organism with predicted taxonomy: Clostridiales
  REGION 1..1389: note = MG23-59 effector
MEINLENNAEEIIMGKKMYIGIDMGTSSVGMAVTDENYNLYRVKGKDFWTSRLFKEASTAANRRTNRVARRRRQRELARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIRPLSEWTIDNLEDYYMSAPVKRMVWQTVKMLNETCELTGRIPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVHGALSNKVTVWSSKSAKKNPDAYMSVKTTDEKACDVTKYGGFTAIANSGYTLVEYNINGKMIRSIEALPVYLGRKNMLTDDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1814 - protein, 1389 aa, unidentified
  REGION 1..1389: note = Description of Unknown:uncultivated organism with predicted taxonomy: Clostridiales
  REGION 1..1389: note = MG23-60 effector
MEINLENNAEEIIMGKKMYIGIDMGTSSVGMAVTDENYNLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQVLWQTNHNLMELMSDQYDFKTNLMELSEETIKPLSEWTIDNLEDYYMSTPVKRMVWQTVKMLNETCELTGRVPDKIFVEMPREHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKATFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLGSKLNARPYNNNRWNIYKIMDNKEEIFAGLSIEKQCYVINQIISWINSKTQNVDLSDIKGSSHSGTMTLNKKISDCSQFELIYQSVTGMYEKRTDLLKL

SEQ ID NO: 1815 - protein, 881 aa, unidentified
  REGION 1..881: note = Description of Unknown:uncultivated organism with predicted taxonomy: Clostridiales
  REGION 1..881: note = MG23-61 effector
MGKNMYIGVDMGTSSVGMAVTDENYTLYRVKGKDFWTSRLFKEANTAAERRTNRVARRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVTDEENKKFSISFTDSNYEDEETQAKDILGDEYFELIEIIKELHDIGVLSGIIKGHKFLSEARVELYEEHKKDLDMLEQVLKKYDKNAYDEMFRVMKEGNYSAYVGSVNARGKNKKIKRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNKAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKD

SEQ ID NO: 1816 - protein, 1368 aa, unidentified; identical to SEQ ID NO: 1788
  REGION 1..1368: note = Description of Unknown:uncultivated organism with predicted taxonomy: Butyrivibriosp. CAG:318
  REGION 1..1368: note = MG23-62 effector

SEQ ID NO: 1817 - protein, 1366 aa, unidentified
  REGION 1..1366: note = Description of Unknown:uncultivated organism with predicted taxonomy: Butyrivibriosp. CAG:318
  REGION 1..1366: note = MG23-63 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1818 - protein, 1376 aa, unidentified; identical to SEQ ID NO: 1800
  REGION 1..1376: note = Description of Unknown:uncultivated organism with predicted taxonomy: Clostridiales
  REGION 1..1376: note = MG23-64 effector

SEQ ID NO: 1819 - protein, 1389 aa, unidentified
  REGION 1..1389: note = Description of Unknown:uncultivated organism with predicted taxonomy: Clostridiales
  REGION 1..1389: note = MG23-65 effector
MEINLENNAEEIIMGKKMYIGIDMGTSSVGMAVTDENYNLYRVKGKDFWTSRLFKEANTAAKRRTNRVSRRRRQRETARMGILRELFSEEINKVDEGFFARLDESKYHIEDRVVKQKYALFADKEYTDKEYYKEYPTIFHLRNELLHPQKNSYDVRLVYLAVANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSLSFTDSNYEDEETQAKDILGDEYFDLIEIIKELHDIGVLSGIIKGHKFLSEARVELYEEHKKDLDMLQQVLKKYDKNAYDEMFRVMKEGNYSAYVGSVNARGKNKKIRRNVGEGKKGRNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKRDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNETCELTGRLPDKIFVEMPREHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITGERNMKFFNTLGSKLNARPYNNNRWNIYKIMENKEEIFAGLSIEKQCYVINQIISWINSKTQNVDLSDIKGSSHSGTMPLNKKISECSQFELIYQSVTGMYEKRTDLLKL

SEQ ID NO: 1820 - protein, 1368 aa, unidentified
  REGION 1..1368: note = Description of Unknown:uncultivated organism with predicted taxonomy: Butyrivibriosp. CAG:318
  REGION 1..1368: note = MG23-66 effector
MDKKMYVGIDMGTNSVGMAVTDEEYNLYRVKGKDLWCSRLFTEADTAAERRTNRISRRRRQREVARQGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADESYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIAGKKPSVQVKQGIYEELFKTGKRVTLNKLKDYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWISDNGKTKQHVLRIMKKNSVTITVKTEEAHGALSNKVTVWSKEKAKGNPDAYMPVKTSDIKAQDVTKYGGITAIANSGYTLVEYKVKGKKVRSLEALPVYLGRSNALTNEDIMQYISAALQNEYAGKEISDLSVRVPFVPQKSKVRIDGFEYYLGGKTGKSVYLSNAMPLYLSGNDEEYLRKIMKAIEIDNYEEIDKDSNAIITEEKNVALFDVLCVKINSEPYINNRWNIYKILEGKEEIFKNLDIEKQCYIIGQIISWINSSTQNVNLKDVCGSEHSGMQQLNKKISECKECILIHQSVTGMYERRIDLLSI

SEQ ID NO: 1821 - protein, 1366 aa, unidentified; identical to SEQ ID NO: 1777
  REGION 1..1366: note = Description of Unknown:uncultivated organism with predicted taxonomy: Butyrivibriosp. CAG:318
  REGION 1..1366: note = MG23-67 effector

SEQ ID NO: 1822 - protein, 1366 aa, unidentified
  REGION 1..1366: note = Description of Unknown:uncultivated organism with predicted taxonomy: Butyrivibriosp. CAG:318
  REGION 1..1366: note = MG23-68 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEEYLPFLLGKDESGLTVSERIVELFRFHIPYYVGPIGAQGENVWAQRRPGEEKGRVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKKLDIKKQCYIIGQIISWINSSTQNVNLKDVCGSEHSGMQRLNKKISECKECILIHQSVTGMYERRIDLLSI

SEQ ID NO: 1823 - protein, 1366 aa, unidentified
  REGION 1..1366: note = Description of Unknown:uncultivated organism with predicted taxonomy: Butyrivibriosp. CAG:318
  REGION 1..1366: note = MG23-69 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVVSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1824 - protein, 1368 aa, unidentified
  REGION 1..1368: note = Description of Unknown:uncultivated organism with predicted taxonomy: Butyrivibriosp. CAG:318
  REGION 1..1368: note = MG23-70 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLTGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1825 - protein, 774 aa, unidentified
  REGION 1..774: note = Description of Unknown:uncultivated organism with predicted taxonomy: Butyrivibriosp. YAB3001
  REGION 1..774: note = MG23-71 effector
GNFLNESLSTNSNSVSISDAYQNLVEIANLFDISFPANIDVTKLQDILSDRTTSKRVKLEQLVELMGIVKKASPAEYELLQMCCGMKGKLSNIFGEVISEEDKAFSFSFSDSKYEENAGKALELVGDEYYEIIDAVKEVYDIGLLANIMKGEKYLSDARVADYKAHKKDLALLKQVIREYAEDEYDNFFRKMDEGNYSAYVGSVNSKLEKIRRNGNKGRSQEDLYKTIQTIIKNMREEDKEDSRVKEILSKIEAGSFLPKQLTGSNGVIPNQVHEREMKQILENASTYLPFLREKDESGLSVAERILKMFTFHIPYYIGPLGQEHLDENGYNVWARRIAPGPIYPWNIEEKIDVNEAAEKFITRMLRKCTYIQDEQALPKQSLLYEKFMVLNELNNLRIFGEKISVEVKQNIFNELFMKGKKVTRDNLIKYLVASGVISKNESAEEAISGVDGDFKSYLSSVNKFESIFGKESIYGSKREMIEKIIFWGTVFGKDKRIIKEKLKKEYGSELSDDVIKRIAGFNFSGWGNLSEELLEMPGSCGTDEEEKSIIICLWETNENLMELLGSSHTFKKEIENRIATQNKELMEWTIEDLDGMYLSPSVKRRVWQTLKVLKEIYQVTGGEPEKIFVEMPREEGEKGKRTESRKKKLEFLYKGQKQFLQEIGKRDERDFRQKKLYLYYLQNGKSMYTGNEIDLDELLSNNSKYDIDHIYPRHYIKDDSLDNNLVLVEKEINNDIKGGDYPISKTIQSKMRSFWKELQEKGFITSEKYNRLV

SEQ ID NO: 1826 - protein, 1386 aa, unidentified
  REGION 1..1386: note = Description of Unknown:uncultivated organism with predicted taxonomy: Eubacterium
  REGION 1..1386: note = MG23-72 effector
MDRDDKKMYVGIDMGTNSVGLAVTDENYNLYRVKGKDFWCSRIFSKAETAEVRRVNRISRRRRQRETARQGILREFFAEEINKVDEGFFARLDESKYHIEDRENQQKYTLFIDNGYTDKEYYAEYPTIFHLRNELLHPQKDSYDVRLVYLAISNMFKHRGNFLNETLDMGKVTSSAGDIYQQLVEEAMLYVIELPVSIDVERLINIIGEKGVSRSKHLENVSSYLGITKKDKSAYEILKLVCGMSGLLFNIYGEEIIDEENKKFSLNFRDTNYEEKEGKALELLGNDNFQLIEIIKELHDIGVLSSIIKGHKFLSESRVELYEEHKKDLDMLQVVLKRYDKKAYNDMFRIMKEGNYSAYVGSVNSIGQNEKRSEKCQKQKIRRNRGKGSSQEVFYKYVKSVLKKLPEDDKDVKKIMEKIENETFMPKQLTASNGVIPNQLHTVELRAILENAEKYLSFLLNKDESGLTVSQRIVELFKFHIPYYVGPIGASGQNVWAKRRKGEEKGRIYPWNFEQKIDTQAAAEEFIGRMVRHCTYLANERTLPKQSLLYEKYMVLNELNNMKINGIKPDVSVKQGIYDDLFKKGKRVTLNALKSYLYNNSIIESKEDVVITGIDIVHNGGFSASLTSVGKFIGVLGDELFTDENQTMVEQIIFWGTVYGNDKKFLKNRIQETYAGRLTWEQIKRIAGFKFNGWGNLSKAFLELKGNCECGECSIIQALWETNHNLMELLADQYDFKKNLEAMSNNVEKPLQEWTIEDLEGKYLSAPVKRMVWQTMKMLREVCELTGRQPDKVFVEMPREEGIKNERKNSRKKKLLELYTSIKNEQKAWSEVKIREIDGRTETDFRIKKLYLYYLQQGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQLVETRQGTKAITQILKQAFPDTQIIFVKAGVVSDFRKKFNINKVRALNDTHHAKDAYLNIVVGNIYNTKFTSNPINFIKDARKNVNDVSYKYNMDKMFDYNVCRNGENAWIADNGKSKQHVLSVLGKNSVIITRKTEENHGALSNKVTVWSKETAKKNPGAYMPVKTTDSKAQDVTKYGGITSVASSGYTLIEYKVKGKIIRSIEALPVYLGKSDTLTEEKILEYIGESLEKEYKDKKISDIKVRVKFIPLKSKIRLDGFNYYLGGKTGNYIYLNNNEALYLNNNDEEYLRKITKAIDITNYEEIDENGNVIITHEKNTKLFNVLCEKLNNKPYINNRWNIYNVLEGKEEIFRKLDVEKQCYIINQIILWGNSAVQNINLKYINGKEHEGSLLMNKKISEYDEVVLIQQSVTGMYERKTDLLKV

SEQ ID NO: 1827 - protein, 114 aa, unidentified
  REGION 1..114: note = Description of Unknown:uncultivated organism with predicted taxonomy: CandidatusMelainabacteria
  REGION 1..114: note = MG1-4 RuvC-III domain
AETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDK

SEQ ID NO: 1828 - protein, 142 aa, unidentified
  REGION 1..142: note = Description of Unknown:uncultivated organism with predicted taxonomy: Verrucomicrobia
  REGION 1..142: note = MG1-5 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLAEVVPTKVAIKK

SEQ ID NO: 1829 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-6 RuvC-III domain
AETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1830 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-7 RuvC-III domain
AETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKK

SEQ ID NO: 1831 - protein, 137 aa, unidentified
  REGION 1..137: note = Description of Unknown:uncultivated organism
  REGION 1..137: note = MG1-1 RuvC-III domain
AETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFER

SEQ ID NO: 1832 - protein, 127 aa, unidentified
  REGION 1..127: note = Description of Unknown:uncultivated organism with predicted taxonomy: Verrucomicrobia
  REGION 1..127: note = MG1-2 RuvC-III domain
AETAWISKLAQTILNLKFGWTNGNTPDGRKAVVVVPGGLTARIRRKYSLNSLLAGDGVDEEEAEKKNRKDHRHHALDAMVISFLPGWVANPDKEHFFRFPEPVRANPRGFFQTAIHNVVPRQLCFEK

SEQ ID NO: 1833 - protein, 137 aa, unidentified
  REGION 1..137: note = Description of Unknown:uncultivated organism
  REGION 1..137: note = MG1-3 RuvC-III domain
QLARQLRAEIMRWMQVDDKPDEAARRIGTPSGWLAAQARKSWLPAEEYEKVRNNVTHHLIDAAILAHIPPREGMNSVRCKGIFYVESVPVRDPVTGDTTYRLETKALPELSPLPRLKHWLPDNGEYDVCPVWKPRRQ

SEQ ID NO: 1834 - protein, 137 aa, unidentified; identical to SEQ ID NO: 1833
  REGION 1..137: note = Description of Unknown:uncultivated organism
  REGION 1..137: note = MG1-13 RuvC-III domain

SEQ ID NO: 1835 - protein, 140 aa, unidentified
  REGION 1..140: note = Description of Unknown:uncultivated organism
  REGION 1..140: note = MG1-8 RuvC-III domain
AETAWISKLAQTIVNLRFGWRNGVDYSGPQPVKRVIVVSGGLTARVRAKYGLDKLLYGENTPPEVLAKKVKNRDDDRHHALDAMVMTFIPHWARDPNKQGFFRFPPAFRDANGREDYQQIQSLFARQLEKIVPRHLAYEP

SEQ ID NO: 1836 - protein, 176 aa, unidentified
  REGION 1..176: note = Description of Unknown:uncultivated organism with predicted taxonomy: Verrucomicrobia
  REGION 1..176: note = MG1-9 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRTKEDFFRFPTAIGDNDFYSKEDQPEMAAIKSQLAKLYVENKPVFR

SEQ ID NO: 1837 - protein, 138 aa, unidentified
  REGION 1..138: note = Description of Unknown:uncultivated organism
  REGION 1..138: note = MG1-10 RuvC-III domain
QLASQLRKQVAFWLGIHADSDDLSAAVALRERIGNPQGQYTAAMRRSLLPESGKDRSGYVHHREDAALLSCMPPMGLNSIKYKGIFYTKMVPWLDSSGQLQQRRSLFALSCADGLPLPDIASILEDDTECPIIKRRSE

SEQ ID NO: 1838 - protein, 123 aa, unidentified
  REGION 1..123: note = Description of Unknown:uncultivated organism
  REGION 1..123: note = MG1-11 RuvC-III domain
QLARELRRYIAVWMGINRDVDAVRERIGNPCGSYTAAARRGMLPADYRKDRSNNLHHRIDAAVLTCIPPAAGLNNLRCGGIFRNTRINGKRCTTTIPGLPLPDFGALIADDSTCPLVSRRRTG

SEQ ID NO: 1839 - protein, 125 aa, unidentified
  REGION 1..125: note = Description of Unknown:uncultivated organism
  REGION 1..125: note = MG1-12 RuvC-III domain
QLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNR

SEQ ID NO: 1840 - protein, 137 aa, unidentified; identical to SEQ ID NO: 1831
  REGION 1..137: note = Description of Unknown:uncultivated organism
  REGION 1..137: note = MG1-14 RuvC-III domain

SEQ ID NO: 1841 - protein, 130 aa, unidentified
  REGION 1..130: note = Description of Unknown:uncultivated organism
  REGION 1..130: note = MG1-20 RuvC-III domain
AVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNK

SEQ ID NO: 1842 - protein, 130 aa, unidentified; identical to SEQ ID NO: 1841
  REGION 1..130: note = Description of Unknown:uncultivated organism with predicted taxonomy: CandidatusPeregrinibacteria bacterium CG10_big_fil_rev_8_21_14_0_10_54_7
  REGION 1..130: note = MG1-21 RuvC-III domain

SEQ ID NO: 1843 - protein, 130 aa, unidentified; identical to SEQ ID NO: 1841
  REGION 1..130: note = Description of Unknown:uncultivated organism with predicted taxonomy: CandidatusPeregrinibacteria bacterium CG10_big_fil_rev_8_21_14_0_10_54_7
  REGION 1..130: note = MG1-22 RuvC-III domain

SEQ ID NO: 1844 - protein, 114 aa, unidentified
  REGION 1..114: note = Description of Unknown:uncultivated organism with predicted taxonomy: CandidatusMelainabacteria bacterium
  REGION 1..114: note = MG1-23 RuvC-III domain
AETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDK

SEQ ID NO: 1845 - protein, 114 aa, unidentified
  REGION 1..114: note = Description of Unknown:uncultivated organism
  REGION 1..114: note = MG1-24 RuvC-III domain
AETAYIARVAQQITAFCFGWGLQVEGEKRHIFVNNGSSTHAIRRRYGLNSLLGNDIKKNRDNDKHHALDAICISFSRDFKYDEKSKVDVIDGFTKEMVKKVLDEIIPYPYTNKK

SEQ ID NO: 1846 - protein, 120 aa, unidentified
  REGION 1..120: note = Description of Unknown:uncultivated organism
  REGION 1..120: note = MG1-25 RuvC-III domain
AETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDK

SEQ ID NO: 1847 - protein, 114 aa, unidentified
  REGION 1..114: note = Description of Unknown:uncultivated organism
  REGION 1..114: note = MG1-26 RuvC-III domain
AETSHIARVAQQMTAFIFGWGLQVQGKNRRIFVNNGSSTCAIRKRYDLNKLLGDDRKKNRENDKHHALDAICISFSRDFKYDKEIKKDIIKGFNPEIVKDAIDKIMPYPYANDK

SEQ ID NO: 1848 - protein, 120 aa, unidentified
  REGION 1..120: note = Description of Unknown:uncultivated organism
  REGION 1..120: note = MG1-27 RuvC-III domain
AETAQIARVAQDITAFIFGWGLQLKDEKRRIFVNNGASTSGIRKTYRLNKLLGNDVKKNRNNDKHHALDAICISFSQNYKYNKHTKRDEIEGLDIHDNEFRELIKQTLDAIIPYPYTNDK

SEQ ID NO: 1849 - protein, 114 aa, unidentified
  REGION 1..114: note = Description of Unknown:uncultivated organism
  REGION 1..114: note = MG1-28 RuvC-III domain
AETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKK

SEQ ID NO: 1850 - protein, 114 aa, unidentified; identical to SEQ ID NO: 1845
  REGION 1..114: note = Description of Unknown:uncultivated organism
  REGION 1..114: note = MG1-29 RuvC-III domain

SEQ ID NO: 1851 - protein, 114 aa, unidentified; identical to SEQ ID NO: 1849
  REGION 1..114: note = Description of Unknown:uncultivated organism
  REGION 1..114: note = MG1-30 RuvC-III domain

SEQ ID NO: 1852 - protein, 120 aa, unidentified
  REGION 1..120: note = Description of Unknown:uncultivated organism
  REGION 1..120: note = MG1-31 RuvC-III domain
AETAQIARVAQDITAFIFSWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDK

SEQ ID NO: 1853 - protein, 120 aa, unidentified
  REGION 1..120: note = Description of Unknown:uncultivated organism
  REGION 1..120: note = MG1-32 RuvC-III domain
AETAQIARVAQDITAFIFGWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDK

SEQ ID NO: 1854 - protein, 120 aa, unidentified; identical to SEQ ID NO: 1852
  REGION 1..120: note = Description of Unknown:uncultivated organism
  REGION 1..120: note = MG1-33 RuvC-III domain

SEQ ID NO: 1855 - protein, 114 aa, unidentified; identical to SEQ ID NO: 1847
  REGION 1..114: note = Description of Unknown:uncultivated organism with predicted taxonomy: CandidatusGastranaerophilales bacterium HUM_9
  REGION 1..114: note = MG1-34 RuvC-III domain

SEQ ID NO: 1856 - protein, 120 aa, unidentified; identical to SEQ ID NO: 1846
  REGION 1..120: note = Description of Unknown:uncultivated organism
  REGION 1..120: note = MG1-35 RuvC-III domain

SEQ ID NO: 1857 - protein, 115 aa, unidentified
  REGION 1..115: note = Description of Unknown:uncultivated organism with predicted taxonomy: Clostridium
  REGION 1..115: note = MG1-36 RuvC-III domain
EDTQYIAKWITNYIRRNIQFVECSKYNNKVLIISSNLTSYINRKLDISNNIIIGNQKHALDALVTATVSKELLNKIIIYSRENTENSQFPIPWENFKQDMNNLPPIFVSRAPKRK

SEQ ID NO: 1858 - protein, 120 aa, unidentified; identical to SEQ ID NO: 1846
  REGION 1..120: note = Description of Unknown:uncultivated organism
  REGION 1..120: note = MG1-37 RuvC-III domain

SEQ ID NO: 1859 - protein, 114 aa, unidentified; identical to SEQ ID NO: 1844
  REGION 1..114: note = Description of Unknown:uncultivated organism with predicted taxonomy: CandidatusMelainabacteria bacterium
  REGION 1..114: note = MG1-38 RuvC-III domain

SEQ ID NO: 1860 - protein, 120 aa, unidentified; identical to SEQ ID NO: 1852
  REGION 1..120: note = Description of Unknown:uncultivated organism
  REGION 1..120: note = MG1-39 RuvC-III domain

SEQ ID NO: 1861 - protein, 120 aa, unidentified; identical to SEQ ID NO: 1853
  REGION 1..120: note = Description of Unknown:uncultivated organism
  REGION 1..120: note = MG1-40 RuvC-III domain

SEQ ID NO: 1862 - protein, 114 aa, unidentified; identical to SEQ ID NO: 1847
  REGION 1..114: note = Description of Unknown:uncultivated organism with predicted taxonomy: CandidatusGastranaerophilales bacterium HUM_9
  REGION 1..114: note = MG1-41 RuvC-III domain

SEQ ID NO: 1863 - protein, 120 aa, unidentified; identical to SEQ ID NO: 1848
  REGION 1..120: note = Description of Unknown:uncultivated organism
  REGION 1..120: note = MG1-42 RuvC-III domain

SEQ ID NO: 1864 - protein, 120 aa, unidentified; identical to SEQ ID NO: 1852
  REGION 1..120: note = Description of Unknown:uncultivated organism
  REGION 1..120: note = MG1-43 RuvC-III domain

SEQ ID NO: 1865 - protein, 114 aa, unidentified; identical to SEQ ID NO: 1849
  REGION 1..114: note = Description of Unknown:uncultivated organism
  REGION 1..114: note = MG1-44 RuvC-III domain

SEQ ID NO: 1866 - protein, 114 aa, unidentified; identical to SEQ ID NO: 1847
  REGION 1..114: note = Description of Unknown:uncultivated organism with predicted taxonomy: CandidatusMelainabacteria
  REGION 1..114: note = MG1-45 RuvC-III domain

SEQ ID NO: 1867 - protein, 114 aa, unidentified; identical to SEQ ID NO: 1849
  REGION 1..114: note = Description of Unknown:uncultivated organism
  REGION 1..114: note = MG1-46 RuvC-III domain

SEQ ID NO: 1868 - protein, 120 aa, unidentified; identical to SEQ ID NO: 1848
  REGION 1..120: note = Description of Unknown:uncultivated organism
  REGION 1..120: note = MG1-47 RuvC-III domain

SEQ ID NO: 1869 - protein, 114 aa, unidentified
  REGION 1..114: note = Description of Unknown:uncultivated organism
  REGION 1..114: note = MG1-48 RuvC-III domain
AETAQIARVAQQLAAFIFGWGMQTEGDKRHLFINNGSTTAAIRRRYGLNKLLGDDIKKNRENDKHHALDAICISFSKDFKYDHKSKKDIIEGFTYDFVKNEIDKLIPYPYANDK

SEQ ID NO: 1870 - protein, 114 aa, unidentified
  REGION 1..114: note = Description of Unknown:uncultivated organism
  REGION 1..114: note = MG1-49 RuvC-III domain
NETTQIAKIVQSVTASVLEWDLQVKDKNRHIFISDGSSTHKIRQQYKLDRLLDDNAKKNRENGKHRALDAICISYSKDFQYNTEQHKYEIENIDIPHIEDVINHVVPYPYTNDK

SEQ ID NO: 1871 - protein, 114 aa, unidentified; identical to SEQ ID NO: 1870
  REGION 1..114: note = Description of Unknown:uncultivated organism
  REGION 1..114: note = MG1-50 RuvC-III domain

SEQ ID NO: 1872 - protein, 114 aa, unidentified
  REGION 1..114: note = Description of Unknown:uncultivated organism with predicted taxonomy: CandidatusMelainabacteria bacterium
  REGION 1..114: note = MG1-51 RuvC-III domain
ADTAQIAKVAQQLAAFIFGWGMQTDGDKRHLFVNNGSTTAAIRRRYGLNKILGNDIKKNRENDKHHALDAICISFSQDFKYDPKSQKDIINGFTYDFVKNEIDKLIPYPYANNK

SEQ ID NO: 1873 - protein, 114 aa, unidentified
  REGION 1..114: note = Description of Unknown:uncultivated organism
  REGION 1..114: note = MG1-52 RuvC-III domain
AETAQIARVAQQLAAFIFGLGMQTEGDKRHLFVNNGSTTAAIRRRYGLNKLLGDDVKKNRENDKHHALDAICISFSRDFKYDEKSKKDVIEGFTYDFVKKAIDELIPYPYANDK

SEQ ID NO: 1874 - protein, 114 aa, unidentified; identical to SEQ ID NO: 1870
  REGION 1..114: note = Description of Unknown:uncultivated organism
  REGION 1..114: note = MG1-53 RuvC-III domain

SEQ ID NO: 1875 - protein, 114 aa, unidentified; identical to SEQ ID NO: 1870
  REGION 1..114: note = Description of Unknown:uncultivated organism
  REGION 1..114: note = MG1-54 RuvC-III domain

SEQ ID NO: 1876 - protein, 114 aa, unidentified; identical to SEQ ID NO: 1870
  REGION 1..114: note = Description of Unknown:uncultivated organism
  REGION 1..114: note = MG1-55 RuvC-III domain

SEQ ID NO: 1877 - protein, 114 aa, unidentified
  REGION 1..114: note = Description of Unknown:uncultivated organism
  REGION 1..114: note = MG1-56 RuvC-III domain
AETAHIARVAQQITAFIFDWGLQLEGENRHIFVNNGSSTCAIRKRYHLNSLLGDDEKKNRSNDKHHALDAICISYSRDFKYDKNIKKDTIEEFNPEVVKKVIDEIIPYPYANKK

SEQ ID NO: 1878 - protein, 114 aa, unidentified
  REGION 1..114: note = Description of Unknown:uncultivated organism
  REGION 1..114: note = MG1-57 RuvC-III domain
NETAQIAKVAQSITAFILGWGLQVKGENRHIFVNNGSSTHKIRQQFKLNRLLGNDEKKNRENDKHHALDAICISYSKDFRYNTEKHKYEIDNLDIPHIEEVINSIVPYPYTNDK

SEQ ID NO: 1879 - protein, 114 aa, unidentified
  REGION 1..114: note = Description of Unknown:uncultivated organism with predicted taxonomy: CandidatusTermititenax aidoneus
  REGION 1..114: note = MG1-58 RuvC-III domain
AETAQIARVAQEITAFVFGWGMQTSGDDRHIFVNNGSSTSAIRRRYGLNKILGDDVKKNRENDKHHALDAICISFSRDFKYDEHSKKDVIKGFTYDFVKKEIDKLMPYPYANDK

SEQ ID NO: 1880 - protein, 141 aa, unidentified
  REGION 1..141: note = Description of Unknown:uncultivated organism with predicted taxonomy: Verrucomicrobia
  REGION 1..141: note = MG1-59 RuvC-III domain
AETAWISKLAQRICCLHFGFQFGGLTGAKKVWTVSGNTTAMIRGRYGLNRLLHDEESAADSLFDRICMEKKFEEKNRKNKKHHALDAMCLCFAPTSNAKKASAYKNILPEEITRNPESDEARKFFGKYLANVIPNKVAVEK

SEQ ID NO: 1881 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-60 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1882 - protein, 129 aa, unidentified
  REGION 1..129: note = Description of Unknown:uncultivated organism
  REGION 1..129: note = MG1-61 RuvC-III domain
AETAYIAKMSQKIAHLFFGWSQGTLGSKKKVIVANGSLTAKMRGLYGLNRILHSGISEEEYKELVKSGKIDEKNRDNPRHHALDAIVLSMLPEIQMNDRKKDFFPIWFTPDYCRENLEKCFPKHIKYEK

SEQ ID NO: 1883 - protein, 129 aa, unidentified; identical to SEQ ID NO: 1882
  REGION 1..129: note = Description of Unknown:uncultivated organism with predicted taxonomy:Deltaproteobacteria
  REGION 1..129: note = MG1-62 RuvC-III domain

SEQ ID NO: 1884 - protein, 176 aa, unidentified
  REGION 1..176: note = Description of Unknown:uncultivated organism with predicted taxonomy: Verrucomicrobiabacterium 61-8
  REGION 1..176: note = MG1-63 RuvC-III domain
AESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRTKEDFFRFPTAIGDNDFYSKEDQPEMAAIKSELAKLYVENKPVFR

SEQ ID NO: 1885 - protein, 176 aa, unidentified
  REGION 1..176: note = Description of Unknown:uncultivated organism
  REGION 1..176: note = MG1-64 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSELAKLYVENKPVFR

SEQ ID NO: 1886 - protein, 179 aa, unidentified
  REGION 1..179: note = Description of Unknown:uncultivated organism with predicted taxonomy: Verrucomicrobia
  REGION 1..179: note = MG1-65 RuvC-III domain
ATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEK

SEQ ID NO: 1887 - protein, 129 aa, unidentified
  REGION 1..129: note = Description of Unknown:uncultivated organism
  REGION 1..129: note = MG1-66 RuvC-III domain
AETSYISRLAQKIVHLYFGWEQLTKGSSRRVFVVSGAFTKRIRDLFKLDAILYPDLTLEEVYKYSAEEREEKNRNNPRHHALDALVVSITQEIKYNPLKGKDEYPEWFTPEFCKQAVERCLPVKVRFEK

SEQ ID NO: 1888 - protein, 176 aa, unidentified
  REGION 1..176: note = Description of Unknown:uncultivated organism
  REGION 1..176: note = MG1-67 RuvC-III domain
AESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRNKEDFFRFPTAIGDNDLYSKEDQPKIEAIKSKLAKLYEENGAVFR

SEQ ID NO: 1889 - protein, 129 aa, unidentified
  REGION 1..129: note = Description of Unknown:uncultivated organism with predicted taxonomy: Elusimicrobiabacterium HGW-Elusimicrobia-1
  REGION 1..129: note = MG1-68 RuvC-III domain
AETAYIAKLSQKICHLFFGWEQGTEGSKRKVIVANGGLTAKMRNAYDLNRILHTGLSDAEYKELCKSGEIDKKNRDNPRHHALDAMVISMIPEIKMNDRKKDFFPIWFNPDYCREKLEQCFPKNIRYEK

SEQ ID NO: 1890 - protein, 140 aa, unidentified
  REGION 1..140: note = Description of Unknown:uncultivated organism with predicted taxonomy: Pedosphaera sp.Tous-C6FEB
  REGION 1..140: note = MG1-69 RuvC-III domain
AETAWISKLAQTIVNLRFGWRNGVDYSGPQPVKRVIVVSGGLTARVRRKYGLDKLLYGEDTAPEVLAKKVKNRDDDRHHALDAMVMTFIPHWARDPNKQGFFRFPPAFRDANGREDYQRIRSLFASHLQQIVPRHLAYEP

SEQ ID NO: 1891 - protein, 123 aa, unidentified
  REGION 1..123: note = Description of Unknown:uncultivated organism with predicted taxonomy: Endomicrobium
  REGION 1..123: note = MG1-70 RuvC-III domain
AETSYISRLAQRIVHLFFGWEQLTKGSTRHVYVVSGALTKYIRDKFELDVLLYPDLTKEEVFKIPSEEREEKNRNNPRHHALDALVVSIARPENVDKYPEWFTQDFCRMAIEKCLPVKVRFEK

SEQ ID NO: 1892 - protein, 179 aa, unidentified; identical to SEQ ID NO: 1886
  REGION 1..179: note = Description of Unknown:uncultivated organism
  REGION 1..179: note = MG1-71 RuvC-III domain

SEQ ID NO: 1893 - protein, 105 aa, unidentified
  REGION 1..105: note = Description of Unknown:uncultivated organism with predicted taxonomy:Deltaproteobacteria
  REGION 1..105: note = MG1-72 RuvC-III domain
AETAWISKLAQTIVNLRFGWRNGVDYSGPQPVKRVIVVSGGLTARVRAKYGLDKLLYGENTPPEVLAKKVKNRDDDRHHALDAMVMTFIPHWARDPHKEGFFRFP

SEQ ID NO: 1894 - protein, 176 aa, unidentified
  REGION 1..176: note = Description of Unknown:uncultivated organism with predicted taxonomy: Pedosphaera sp.Tous-C6FEB
  REGION 1..176: note = MG1-73 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSQLAKLYVENKPVFR

SEQ ID NO: 1895 - protein, 179 aa, unidentified; identical to SEQ ID NO: 1886
  REGION 1..179: note = Description of Unknown:uncultivated organism
  REGION 1..179: note = MG1-74 RuvC-III domain

SEQ ID NO: 1896 - protein, 83 aa, unidentified
  REGION 1..83: note = Description of Unknown:uncultivated organism
  REGION 1..83: note = MG1-75 RuvC-III domain
QLARQLVAECAHWMGIAGDPDEIQRRIGTPSGYMRAQALRSWEDTVPAKNRSDLVHHLVDAAVVAHIPPGAGMNQVSYGGIFY

SEQ ID NO: 1897 - protein, 130 aa, unidentified
  REGION 1..130: note = Description of Unknown:uncultivated organism
  REGION 1..130: note = MG1-76 RuvC-III domain
AETAYISRLAQKICHLFFGWEQLTKGSQRKVFVVSGAFTRKIRTIFELDRILYPDLSDEEYKELLTKGEIQKKNRDNPRHHVLDTIVLSIIPEIKYNPEREKDDYPVWFNKEYCRQYIEKCFPRPIRFVK

SEQ ID NO: 1898 - protein, 123 aa, unidentified
  REGION 1..123: note = Description of Unknown:uncultivated organism with predicted taxonomy: Verrucomicrobia
  REGION 1..123: note = MG1-78 RuvC-III domain
AETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEK

SEQ ID NO: 1899 - protein, 156 aa, unidentified
  REGION 1..156: note = Description of Unknown:uncultivated organism
  REGION 1..156: note = MG1-79 RuvC-III domain
QLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRK

SEQ ID NO: 1900 - protein, 123 aa, unidentified; identical to SEQ ID NO: 1898
  REGION 1..123: note = Description of Unknown:uncultivated organism with predicted taxonomy: Verrucomicrobia
  REGION 1..123: note = MG1-80 RuvC-III domain

SEQ ID NO: 1901 - protein, 169 aa, unidentified
  REGION 1..169: note = Description of Unknown:uncultivated organism
  REGION 1..169: note = MG1-81 RuvC-III domain
QHTAYIARIVRHVALIRLGWTGDDGRDPTIIKGNKPSSSFQVTNGQLTSRLRQAWGLNHILHPLPEGKRWDDLTDAEKEQMQQKNRGDLRHHALDAMVIACTLPWLAHRTVGATDPETGEHGWWQLDERTRRSLALNPVFPTEGQMRRVAEEWMQKVVVRHHVSRSPHQ

SEQ ID NO: 1902 - protein, 19 aa, unidentified
  REGION 1..19: note = Description of Unknown:uncultivated organism
  REGION 1..19: note = MG1-82 RuvC-III domain
AETAWISKLAQTIVNLRFG

SEQ ID NO: 1903 - protein, 156 aa, unidentified
  REGION 1..156: note = Description of Unknown:uncultivated organism
  REGION 1..156: note = MG1-83 RuvC-III domain
QIARYLRVEIIHWLGLDRIKNEMERNKQIAGRIGTPTGFQTSICRESWTPRTVFPQMYRLLHDKKGIPVRDQHGRERWVKDRTNLRHHLWDAAVLSHIPPREGLNSADCGGIFVHRRDQQTGEWRVSALPNLGPDLVAFEKENEGRCLVAHLRQRK

SEQ ID NO: 1904 - protein, 138 aa, unidentified
  REGION 1..138: note = Description of Unknown:uncultivated organism with predicted taxonomy:Coraliomargarita sp. CAG:312
  REGION 1..138: note = MG1-84 RuvC-III domain
AETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKK

SEQ ID NO: 1905 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-85 RuvC-III domain

SEQ ID NO: 1906 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-86 RuvC-III domain

SEQ ID NO: 1907 - protein, 142 aa, unidentified
  REGION 1..142: note = Description of Unknown:uncultivated organism with predicted taxonomy: Verrucomicrobia
  REGION 1..142: note = MG1-87 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKK

SEQ ID NO: 1908 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-88 RuvC-III domain
AETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1909 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-89 RuvC-III domain

SEQ ID NO: 1910 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-90 RuvC-III domain

SEQ ID NO: 1911 - protein, 142 aa, unidentified
  REGION 1..142: note = Description of Unknown:uncultivated organism
  REGION 1..142: note = MG1-91 RuvC-III domain
AETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEK

SEQ ID NO: 1912 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-92 RuvC-III domain
AETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKK

SEQ ID NO: 1913 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-93 RuvC-III domain

SEQ ID NO: 1914 - protein, 142 aa, unidentified
  REGION 1..142: note = Description of Unknown:uncultivated organism with predicted taxonomy: unclassifiedVerrucomicrobia (miscellaneous)
  REGION 1..142: note = MG1-94 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLEEVVPTKVAIKK

SEQ ID NO: 1915 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-95 RuvC-III domain

SEQ ID NO: 1916 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-96 RuvC-III domain

SEQ ID NO: 1917 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-97 RuvC-III domain

SEQ ID NO: 1918 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-98 RuvC-III domain

SEQ ID NO: 1919 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-99 RuvC-III domain

SEQ ID NO: 1920 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-100 RuvC-III domain

SEQ ID NO: 1921 - protein, 138 aa, unidentified
  REGION 1..138: note = Description of Unknown:uncultivated organism with predicted taxonomy: unclassifiedVerrucomicrobia (miscellaneous)
  REGION 1..138: note = MG1-101 RuvC-III domain
AETAWISKLAQQVVCLHFGFQFGGMEGQRRVFCIPGGVTARIRGMFGLNELLHVKDYDTDSMSETEIVELHKRLEKKNRENKKHHALDAMCLCFAPTGSQIKRFDAKTIMPEGILGREKQYFKSYLDKIVPNEVATQK

SEQ ID NO: 1922 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-102 RuvC-III domain

SEQ ID NO: 1923 - protein, 140 aa, unidentified
  REGION 1..140: note = Description of Unknown:uncultivated organism with predicted taxonomy: Verrucomicrobia
  REGION 1..140: note = MG1-103 RuvC-III domain
AETAHIAKLAQKIVCMHFGFQFGGLSGTKRVFTLPGALTSRIRKFYGLDRILHISAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1924 - protein, 138 aa, unidentified; identical to SEQ ID NO: 1904
  REGION 1..138: note = Description of Unknown:uncultivated organism with predicted taxonomy: Verrucomicrobia
  REGION 1..138: note = MG1-104 RuvC-III domain

SEQ ID NO: 1925 - protein, 140 aa, unidentified
  REGION 1..140: note = Description of Unknown:uncultivated organism
  REGION 1..140: note = MG1-105 RuvC-III domain
AETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKK

SEQ ID NO: 1926 - protein, 142 aa, unidentified
  REGION 1..142: note = Description of Unknown:uncultivated organism with predicted taxonomy: Verrucomicrobia
  REGION 1..142: note = MG1-106 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEK

SEQ ID NO: 1927 - protein, 142 aa, unidentified; identical to SEQ ID NO: 1907
  REGION 1..142: note = Description of Unknown:uncultivated organism with predicted taxonomy: Verrucomicrobia
  REGION 1..142: note = MG1-107 RuvC-III domain

SEQ ID NO: 1928 - protein, 142 aa, unidentified
  REGION 1..142: note = Description of Unknown:uncultivated organism with predicted taxonomy: Verrucomicrobia
  REGION 1..142: note = MG1-108 RuvC-III domain
AETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEK

SEQ ID NO: 1929 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-109 RuvC-III domain

SEQ ID NO: 1930 - protein, 142 aa, unidentified
  REGION 1..142: note = Description of Unknown:uncultivated organism with predicted taxonomy: Verrucomicrobia
  REGION 1..142: note = MG1-110 RuvC-III domain
AETAWISKLAQRICCLHFGFQFGGLAGAKKVWTVSGNTTAMIRGRYGLNRLLHDEESAEDLSLFDRICMEKKLEEKNRKNKKHHALDAMCLCFAPTSNAKKASAYKNILPEEITRNPESDEARKFFGKYLANVIPNKVAVEK

SEQ ID NO: 1931 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-111 RuvC-III domain

SEQ ID NO: 1932 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-112 RuvC-III domain

SEQ ID NO: 1933 - protein, 140 aa, unidentified
  REGION 1..140: note = Description of Unknown:uncultivated organism with predicted taxonomy: Verrucomicrobia
  REGION 1..140: note = MG1-113 RuvC-III domain
AETAHISKLAQKIVCLHFGFQFGGLGGTKRVFTVPGALTARIRSFYGLNKILHNEDLAKDALSYEEVLKRGEELDKKNRENEKHHALDAMCLCFAPTGVNSKRARIDMLLPPDIRGEGKAELFFRKYLDRLIPVDVAPKK

SEQ ID NO: 1934 - protein, 140 aa, unidentified; identical to SEQ ID NO: 1912
  REGION 1..140: note = Description of Unknown:uncultivated organism with predicted taxonomy: unclassifiedVerrucomicrobia (miscellaneous)
  REGION 1..140: note = MG1-114 RuvC-III domain

SEQ ID NO: 1935 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-115 RuvC-III domain

SEQ ID NO: 1936 - protein, 142 aa, unidentified
  REGION 1..142: note = Description of Unknown:uncultivated organism with predicted taxonomy: Verrucomicrobia
  REGION 1..142: note = MG1-116 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGRYLATVIPNKVAVEK

SEQ ID NO: 1937 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-117 RuvC-III domain

SEQ ID NO: 1938 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-118 RuvC-III domain

SEQ ID NO: 1939 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-119 RuvC-III domain

SEQ ID NO: 1940 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-120 RuvC-III domain
AETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKK

SEQ ID NO: 1941 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-121 RuvC-III domain

SEQ ID NO: 1942 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-122 RuvC-III domain

SEQ ID NO: 1943 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-123 RuvC-III domain
AETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRAKLGEILPEKLRSEKAAREFFKSYLDKIMPVDVAPKK

SEQ ID NO: 1944 - protein, 142 aa, unidentified
  REGION 1..142: note = Description of Unknown:uncultivated organism with predicted taxonomy: Verrucomicrobia
  REGION 1..142: note = MG1-124 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEK

SEQ ID NO: 1945 - protein, 138 aa, unidentified; identical to SEQ ID NO: 1904
  REGION 1..138: note = Description of Unknown:uncultivated organism with predicted taxonomy: Verrucomicrobia
  REGION 1..138: note = MG1-125 RuvC-III domain

SEQ ID NO: 1946 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-126 RuvC-III domain

SEQ ID NO: 1947 - protein, 142 aa, unidentified; identical to SEQ ID NO: 1926
  REGION 1..142: note = Description of Unknown:uncultivated organism with predicted taxonomy: Verrucomicrobia
  REGION 1..142: note = MG1-127 RuvC-III domain

SEQ ID NO: 1948 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-128 RuvC-III domain

SEQ ID NO: 1949 - protein, 142 aa, unidentified
  REGION 1..142: note = Description of Unknown:uncultivated organism with predicted taxonomy: Verrucomicrobia
  REGION 1..142: note = MG1-129 RuvC-III domain
AETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 1950 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-130 RuvC-III domain

SEQ ID NO: 1951 - protein, 140 aa, unidentified; identical to SEQ ID NO: 1912
  REGION 1..140: note = Description of Unknown:uncultivated organism with predicted taxonomy: unclassifiedVerrucomicrobia (miscellaneous)
  REGION 1..140: note = MG1-131 RuvC-III domain

SEQ ID NO: 1952 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-132 RuvC-III domain

SEQ ID NO: 1953 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-133 RuvC-III domain

SEQ ID NO: 1954 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-134 RuvC-III domain

SEQ ID NO: 1955 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-135 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKK

SEQ ID NO: 1956 - protein, 142 aa, unidentified; identical to SEQ ID NO: 1907
  REGION 1..142: note = Description of Unknown:uncultivated organism with predicted taxonomy: Verrucomicrobia
  REGION 1..142: note = MG1-136 RuvC-III domain

SEQ ID NO: 1957 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-137 RuvC-III domain

SEQ ID NO: 1958 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-138 RuvC-III domain

SEQ ID NO: 1959 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-139 RuvC-III domain

SEQ ID NO: 1960 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-140 RuvC-III domain

SEQ ID NO: 1961 - protein, 142 aa, unidentified
  REGION 1..142: note = Description of Unknown:uncultivated organism with predicted taxonomy: Verrucomicrobia
  REGION 1..142: note = MG1-141 RuvC-III domain
AETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 1962 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-142 RuvC-III domain

SEQ ID NO: 1963 - protein, 140 aa, unidentified
  REGION 1..140: note = Description of Unknown:uncultivated organism with predicted taxonomy: Verrucomicrobiabacterium
  REGION 1..140: note = MG1-143 RuvC-III domain
AETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGERKAELFFRKYLDRLIPVDVAPKK

SEQ ID NO: 1964 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-144 RuvC-III domain
AETAHISKLAQKIVCLHFGFQFGGLSGTKRVFTVPGSLTARIRTFYGLNKILHNEDLAHETLSYEGFLKRVEELDKKNRANKKHHALDAMCLCFAPTGVNSKRARVDMLLPPKIRSEKDAELFFRKYLDKLIPVDVAPKK

SEQ ID NO: 1965 - protein, 142 aa, unidentified; identical to SEQ ID NO: 1926
  REGION 1..142: note = Description of Unknown:uncultivated organism with predicted taxonomy: Verrucomicrobia
  REGION 1..142: note = MG1-145 RuvC-III domain

SEQ ID NO: 1966 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-147 RuvC-III domain

SEQ ID NO: 1967 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-148 RuvC-III domain

SEQ ID NO: 1968 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-149 RuvC-III domain

SEQ ID NO: 1969 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-150 RuvC-III domain

SEQ ID NO: 1970 - protein, 140 aa, unidentified
  REGION 1..140: note = Description of Unknown:uncultivated organism with predicted taxonomy: Verrucomicrobia
  REGION 1..140: note = MG1-151 RuvC-III domain
AETAHISKLAQKIVCLHFGFQFGGLGGTKRVFTVTGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKK

SEQ ID NO: 1971 - protein, 142 aa, unidentified; identical to SEQ ID NO: 1911
  REGION 1..142: note = Description of Unknown:uncultivated organism
  REGION 1..142: note = MG1-152 RuvC-III domain

SEQ ID NO: 1972 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-153 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPMDVAPKK

SEQ ID NO: 1973 - protein, 142 aa, unidentified; identical to SEQ ID NO: 1949
  REGION 1..142: note = Description of Unknown:uncultivated organism with predicted taxonomy: Verrucomicrobia
  REGION 1..142: note = MG1-154 RuvC-III domain

SEQ ID NO: 1974 - protein, 142 aa, unidentified
  REGION 1..142: note = Description of Unknown:uncultivated organism with predicted taxonomy: Verrucomicrobia
  REGION 1..142: note = MG1-155 RuvC-III domain
AETAWISKLAQRVCCIHFGFQFGGLTGVKKVWTVSGNTTAMIRSRYGLNRLLHDENVPKDISLSERLKLENDFEKKNRDNKKHHALDAMCLCYAPTSNTRRAASYKNILPAEITRNPESDEARRFFGRYLANVIPNKVAIEK

SEQ ID NO: 1975 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-156 RuvC-III domain

SEQ ID NO: 1976 - protein, 138 aa, unidentified
  REGION 1..138: note = Description of Unknown:uncultivated organism with predicted taxonomy: Verrucomicrobia
  REGION 1..138: note = MG1-157 RuvC-III domain
AETAWISKLAQQVVCLHFGFQFGGMEGQRRVFCIPGGVTARIRGMFGLNELLHVKDYDTDSMSETEIVELYKRLEKKNRENKKHHALDAMCLCFAPTGSQIKRFDAKTIMPEGILGREKQYFKSYLDKIVPNEVATQK

SEQ ID NO: 1977 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-158 RuvC-III domain

SEQ ID NO: 1978 - protein, 136 aa, unidentified
  REGION 1..136: note = Description of Unknown:uncultivated organism with predicted taxonomy:Coraliomargarita sp. CAG:312
  REGION 1..136: note = MG1-159 RuvC-III domain
AETAWIARLAQRIVCMHFGFPMGALIGKKRVFTVSGSVTSRIRGMYGLNKILHNTEIDKTLSEVDILKLNDSLETKNRANKKHHALDAMCLCFAPTSKEVLNKNREILPVEIAKDAENYFRRYLDNIIPNKVATMK

SEQ ID NO: 1979 - protein, 140 aa, unidentified; identical to SEQ ID NO: 1925
  REGION 1..140: note = Description of Unknown:uncultivated organism with predicted taxonomy: unclassifiedVerrucomicrobia (miscellaneous)
  REGION 1..140: note = MG1-160 RuvC-III domain

SEQ ID NO: 1980 - protein, 142 aa, unidentified; identical to SEQ ID NO: 1911
  REGION 1..142: note = Description of Unknown:uncultivated organism with predicted taxonomy: Verrucomicrobia
  REGION 1..142: note = MG1-161 RuvC-III domain

SEQ ID NO: 1981 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-162 RuvC-III domain

SEQ ID NO: 1982 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-163 RuvC-III domain
AETAHISKLAQKIVCLHFGFQFGGLSGTKRVFTVPGSLTARIRTFYGLNKILHNEDLAHETLSFEGFLKRGEELDKKNRANKKHHALDAMCLCFAPTGVNSKRARVDMLLPPKIRSEKDAELFFRKYLDKLIPVDVAPKK

SEQ ID NO: 1983 - protein, 142 aa, unidentified
  REGION 1..142: note = Description of Unknown:uncultivated organism with predicted taxonomy: Verrucomicrobia
  REGION 1..142: note = MG1-164 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARKFFAKYLAEVVPTKVAIKK

SEQ ID NO: 1984 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-165 RuvC-III domain

SEQ ID NO: 1985 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-166 RuvC-III domain
AETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLEKIMPVDVAPKK

SEQ ID NO: 1986 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-167 RuvC-III domain

SEQ ID NO: 1987 - protein, 142 aa, unidentified; identical to SEQ ID NO: 1911
  REGION 1..142: note = Description of Unknown:uncultivated organism with predicted taxonomy: Verrucomicrobia
  REGION 1..142: note = MG1-168 RuvC-III domain

SEQ ID NO: 1988 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-169 RuvC-III domain

SEQ ID NO: 1989 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-170 RuvC-III domain

SEQ ID NO: 1990 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-171 RuvC-III domain

SEQ ID NO: 1991 - protein, 142 aa, unidentified; identical to SEQ ID NO: 1907
  REGION 1..142: note = Description of Unknown:uncultivated organism with predicted taxonomy: Verrucomicrobia
  REGION 1..142: note = MG1-172 RuvC-III domain

SEQ ID NO: 1992 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-173 RuvC-III domain

SEQ ID NO: 1993 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-174 RuvC-III domain

SEQ ID NO: 1994 - protein, 142 aa, unidentified; identical to SEQ ID NO: 1944
  REGION 1..142: note = Description of Unknown:uncultivated organism with predicted taxonomy:Coraliomargarita sp. CAG:312
  REGION 1..142: note = MG1-175 RuvC-III domain

SEQ ID NO: 1995 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-176 RuvC-III domain

SEQ ID NO: 1996 - protein, 142 aa, unidentified; identical to SEQ ID NO: 1926
  REGION 1..142: note = Description of Unknown:uncultivated organism with predicted taxonomy: Verrucomicrobia
  REGION 1..142: note = MG1-177 RuvC-III domain

SEQ ID NO: 1997 - protein, 136 aa, unidentified; identical to SEQ ID NO: 1978
  REGION 1..136: note = Description of Unknown:uncultivated organism with predicted taxonomy:Coraliomargarita sp. CAG:312
  REGION 1..136: note = MG1-178 RuvC-III domain

SEQ ID NO: 1998 - protein, 142 aa, unidentified; identical to SEQ ID NO: 1961
  REGION 1..142: note = Description of Unknown:uncultivated organism with predicted taxonomy:Coraliomargarita sp. CAG:312
  REGION 1..142: note = MG1-179 RuvC-III domain

SEQ ID NO: 1999 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-180 RuvC-III domain
AETAHIAKLAQKIVCMHFGFQFGGVSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2000 - protein, 140 aa, unidentified; identical to SEQ ID NO: 1912
  REGION 1..140: note = Description of Unknown:uncultivated organism with predicted taxonomy: unclassifiedVerrucomicrobia (miscellaneous)
  REGION 1..140: note = MG1-181 RuvC-III domain

SEQ ID NO: 2001 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-182 RuvC-III domain

SEQ ID NO: 2002 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-183 RuvC-III domain

SEQ ID NO: 2003 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-184 RuvC-III domain

SEQ ID NO: 2004 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-185 RuvC-III domain

SEQ ID NO: 2005 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-186 RuvC-III domain

SEQ ID NO: 2006 - protein, 142 aa, unidentified
  REGION 1..142: note = Description of Unknown:uncultivated organism with predicted taxonomy: Verrucomicrobia
  REGION 1..142: note = MG1-187 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 2007 - protein, 138 aa, unidentified; identical to SEQ ID NO: 1904
  REGION 1..138: note = Description of Unknown:uncultivated organism with predicted taxonomy: Verrucomicrobia
  REGION 1..138: note = MG1-188 RuvC-III domain

SEQ ID NO: 2008 - protein, 142 aa, unidentified; identical to SEQ ID NO: 1936
  REGION 1..142: note = Description of Unknown:uncultivated organism with predicted taxonomy: Verrucomicrobia
  REGION 1..142: note = MG1-189 RuvC-III domain

SEQ ID NO: 2009 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-190 RuvC-III domain

SEQ ID NO: 2010 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-191 RuvC-III domain

SEQ ID NO: 2011 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-192 RuvC-III domain

SEQ ID NO: 2012 - protein, 142 aa, unidentified; identical to SEQ ID NO: 1949
  REGION 1..142: note = Description of Unknown:uncultivated organism with predicted taxonomy: Verrucomicrobia
  REGION 1..142: note = MG1-193 RuvC-III domain

SEQ ID NO: 2013 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-194 RuvC-III domain

SEQ ID NO: 2014 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-195 RuvC-III domain

SEQ ID NO: 2015 - protein, 140 aa, unidentified; identical to SEQ ID NO: 1940
  REGION 1..140: note = Description of Unknown:uncultivated organism with predicted taxonomy: Verrucomicrobia
  REGION 1..140: note = MG1-196 RuvC-III domain

SEQ ID NO: 2016 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-197 RuvC-III domain

SEQ ID NO: 2017 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-198 RuvC-III domain

SEQ ID NO: 2018 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-199 RuvC-III domain

SEQ ID NO: 2019 - protein, 142 aa, unidentified; identical to SEQ ID NO: 1949
  REGION 1..142: note = Description of Unknown:uncultivated organism
  REGION 1..142: note = MG1-200 RuvC-III domain

SEQ ID NO: 2020 - protein, 142 aa, unidentified; identical to SEQ ID NO: 1944
  REGION 1..142: note = Description of Unknown:uncultivated organism with predicted taxonomy: Verrucomicrobia
  REGION 1..142: note = MG1-201 RuvC-III domain

SEQ ID NO: 2021 - protein, 142 aa, unidentified; identical to SEQ ID NO: 2006
  REGION 1..142: note = Description of Unknown:uncultivated organism with predicted taxonomy:Coraliomargarita sp. CAG:312
  REGION 1..142: note = MG1-202 RuvC-III domain

SEQ ID NO: 2022 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-203 RuvC-III domain

SEQ ID NO: 2023 - protein, 142 aa, unidentified; identical to SEQ ID NO: 1930
  REGION 1..142: note = Description of Unknown:uncultivated organism with predicted taxonomy: Verrucomicrobia
  REGION 1..142: note = MG1-204 RuvC-III domain

SEQ ID NO: 2024 - protein, 142 aa, unidentified; identical to SEQ ID NO: 1944
  REGION 1..142: note = Description of Unknown:uncultivated organism with predicted taxonomy:Coraliomargarita sp. CAG:312
  REGION 1..142: note = MG1-205 RuvC-III domain

SEQ ID NO: 2025 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-206 RuvC-III domain

SEQ ID NO: 2026 - protein, 140 aa, unidentified; identical to SEQ ID NO: 1940
  REGION 1..140: note = Description of Unknown:uncultivated organism with predicted taxonomy: unclassifiedVerrucomicrobia (miscellaneous)
  REGION 1..140: note = MG1-207 RuvC-III domain

SEQ ID NO: 2027 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-208 RuvC-III domain

SEQ ID NO: 2028 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-209 RuvC-III domain

SEQ ID NO: 2029 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-210 RuvC-III domain

SEQ ID NO: 2030 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-211 RuvC-III domain

SEQ ID NO: 2031 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-212 RuvC-III domain

SEQ ID NO: 2032 - protein, 115 aa, unidentified
  REGION 1..115: note = Description of Unknown:uncultivated organism with predicted taxonomy: unclassifiedVerrucomicrobia (miscellaneous)
  REGION 1..115: note = MG1-213 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLR

SEQ ID NO: 2033 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-214 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRCAKLGEILPEKLRSEKAAREFFKSYLDKIMPVDVAPKK

SEQ ID NO: 2034 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-215 RuvC-III domain

SEQ ID NO: 2035 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-216 RuvC-III domain
AETAHIAKLAQKIVCMHFGFQFGGLSGAKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2036 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-217 RuvC-III domain

SEQ ID NO: 2037 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-218 RuvC-III domain

SEQ ID NO: 2038 - protein, 140 aa, unidentified; identical to SEQ ID NO: 1925
  REGION 1..140: note = Description of Unknown:uncultivated organism with predicted taxonomy: unclassifiedVerrucomicrobia (miscellaneous)
  REGION 1..140: note = MG1-219 RuvC-III domain

SEQ ID NO: 2039 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-220 RuvC-III domain

SEQ ID NO: 2040 - protein, 66 aa, unidentified
  REGION 1..66: note = Description of Unknown:uncultivated organism with predicted taxonomy: unclassifiedVerrucomicrobia (miscellaneous)
  REGION 1..66: note = MG1-221 RuvC-III domain
AETAHIAKLAQKIVCMHFGFQFGGLSGTKRVFAVPGALTSRIRKFYGLDRILHNSEAESENLSFEE

SEQ ID NO: 2041 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-222 RuvC-III domain

SEQ ID NO: 2042 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-223 RuvC-III domain
AETAHIAKLAQKIVCMHFGFQFGRLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2043 - protein, 140 aa, unidentified; identical to SEQ ID NO: 1964
  REGION 1..140: note = Description of Unknown:uncultivated organism with predicted taxonomy: unclassifiedVerrucomicrobia (miscellaneous)
  REGION 1..140: note = MG1-224 RuvC-III domain

SEQ ID NO: 2044 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-225 RuvC-III domain

SEQ ID NO: 2045 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-226 RuvC-III domain

SEQ ID NO: 2046 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-227 RuvC-III domain

SEQ ID NO: 2047 - protein, 140 aa, unidentified
  REGION 1..140: note = Description of Unknown:uncultivated organism with predicted taxonomy: unclassifiedVerrucomicrobia (miscellaneous)
  REGION 1..140: note = MG1-228 RuvC-III domain
AETAHIAKLAQKIVCMHFGFQFGGLSGTKRVFTVPGALTSRIRKFYGLDRILHNSEAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2048 - protein, 140 aa, unidentified; identical to SEQ ID NO: 1881
  REGION 1..140: note = Description of Unknown:uncultivated organism with predicted taxonomy: Verrucomicrobia
  REGION 1..140: note = MG1-229 RuvC-III domain

SEQ ID NO: 2049 - protein, 140 aa, unidentified; identical to SEQ ID NO: 1881
  REGION 1..140: note = Description of Unknown:uncultivated organism with predicted taxonomy: Verrucomicrobia
  REGION 1..140: note = MG1-230 RuvC-III domain

SEQ ID NO: 2050 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-231 RuvC-III domain

SEQ ID NO: 2051 - protein, 142 aa, unidentified; identical to SEQ ID NO: 1949
  REGION 1..142: note = Description of Unknown:uncultivated organism with predicted taxonomy: Verrucomicrobia
  REGION 1..142: note = MG1-232 RuvC-III domain

SEQ ID NO: 2052 - protein, 140 aa, unidentified; identical to SEQ ID NO: 1933
  REGION 1..140: note = Description of Unknown:uncultivated organism
  REGION 1..140: note = MG1-233 RuvC-III domain

SEQ ID NO: 2053 - protein, 140 aa, unidentified; identical to SEQ ID NO: 1955
  REGION 1..140: note = Description of Unknown:uncultivated organism with predicted taxonomy: unclassifiedVerrucomicrobia (miscellaneous)
  REGION 1..140: note = MG1-234 RuvC-III domain

SEQ ID NO: 2054 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-236 RuvC-III domain

SEQ ID NO: 2055 - protein, 140 aa, unidentified; identical to SEQ ID NO: 1908
  REGION 1..140: note = Description of Unknown:uncultivated organism with predicted taxonomy: Verrucomicrobia
  REGION 1..140: note = MG1-237 RuvC-III domain

SEQ ID NO: 2056 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-238 RuvC-III domain

SEQ ID NO: 2057 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-239 RuvC-III domain

SEQ ID NO: 2058 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-240 RuvC-III domain

SEQ ID NO: 2059 - protein, 138 aa, unidentified; identical to SEQ ID NO: 1904
  REGION 1..138: note = Description of Unknown:uncultivated organism with predicted taxonomy: Verrucomicrobia
  REGION 1..138: note = MG1-241 RuvC-III domain

SEQ ID NO: 2060 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-242 RuvC-III domain

SEQ ID NO: 2061 - protein, 142 aa, unidentified; identical to SEQ ID NO: 1974
  REGION 1..142: note = Description of Unknown:uncultivated organism with predicted taxonomy: Verrucomicrobia
  REGION 1..142: note = MG1-243 RuvC-III domain

SEQ ID NO: 2062 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-244 RuvC-III domain

SEQ ID NO: 2063 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-245 RuvC-III domain

SEQ ID NO: 2064 - protein, 140 aa, unidentified; identical to SEQ ID NO: 1940
  REGION 1..140: note = Description of Unknown:uncultivated organism with predicted taxonomy: unclassifiedVerrucomicrobia (miscellaneous)
  REGION 1..140: note = MG1-246 RuvC-III domain

SEQ ID NO: 2065 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-247 RuvC-III domain

SEQ ID NO: 2066 - protein, 140 aa, unidentified; identical to SEQ ID NO: 1970
  REGION 1..140: note = Description of Unknown:uncultivated organism with predicted taxonomy: unclassifiedVerrucomicrobia (miscellaneous)
  REGION 1..140: note = MG1-248 RuvC-III domain

SEQ ID NO: 2067 - protein, 140 aa, unidentified; identical to SEQ ID NO: 1972
  REGION 1..140: note = Description of Unknown:uncultivated organism with predicted taxonomy: unclassifiedVerrucomicrobia (miscellaneous)
  REGION 1..140: note = MG1-249 RuvC-III domain

SEQ ID NO: 2068 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-250 RuvC-III domain

SEQ ID NO: 2069 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-251 RuvC-III domain

SEQ ID NO: 2070 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-252 RuvC-III domain

SEQ ID NO: 2071 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-253 RuvC-III domain

SEQ ID NO: 2072 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-254 RuvC-III domain

SEQ ID NO: 2073 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-255 RuvC-III domain

SEQ ID NO: 2074 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-256 RuvC-III domain

SEQ ID NO: 2075 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-257 RuvC-III domain

SEQ ID NO: 2076 - protein, 142 aa, unidentified; identical to SEQ ID NO: 1911
  REGION 1..142: note = Description of Unknown:uncultivated organism with predicted taxonomy: Verrucomicrobia
  REGION 1..142: note = MG1-258 RuvC-III domain

SEQ ID NO: 2077 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-259 RuvC-III domain

SEQ ID NO: 2078 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-260 RuvC-III domain

SEQ ID NO: 2079 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-261 RuvC-III domain

SEQ ID NO: 2080 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-262 RuvC-III domain

SEQ ID NO: 2081 - protein, 138 aa, unidentified; identical to SEQ ID NO: 1976
  REGION 1..138: note = Description of Unknown:uncultivated organism with predicted taxonomy: Verrucomicrobia
  REGION 1..138: note = MG1-263 RuvC-III domain

SEQ ID NO: 2082 - protein, 140 aa, unidentified; identical to SEQ ID NO: 1830
  REGION 1..140: note = Description of Unknown:uncultivated organism with predicted taxonomy: unclassifiedVerrucomicrobia (miscellaneous)
  REGION 1..140: note = MG1-264 RuvC-III domain

SEQ ID NO: 2083 - protein, 140 aa, unidentified; identical to SEQ ID NO: 1982
  REGION 1..140: note = Description of Unknown:uncultivated organism with predicted taxonomy: unclassifiedVerrucomicrobia (miscellaneous)
  REGION 1..140: note = MG1-265 RuvC-III domain

SEQ ID NO: 2084 - protein, 138 aa, unidentified; identical to SEQ ID NO: 1904
  REGION 1..138: note = Description of Unknown:uncultivated organism with predicted taxonomy:Coraliomargarita sp. CAG:312
  REGION 1..138: note = MG1-266 RuvC-III domain

SEQ ID NO: 2085 - protein, 142 aa, unidentified; identical to SEQ ID NO: 1928
  REGION 1..142: note = Description of Unknown:uncultivated organism with predicted taxonomy: Verrucomicrobia
  REGION 1..142: note = MG1-267 RuvC-III domain

SEQ ID NO: 2086 - protein, 140 aa, unidentified; identical to SEQ ID NO: 1923
  REGION 1..140: note = Description of Unknown:uncultivated organism with predicted taxonomy: Verrucomicrobia
  REGION 1..140: note = MG1-268 RuvC-III domain

SEQ ID NO: 2087 - protein, 140 aa, unidentified; identical to SEQ ID NO: 1881
  REGION 1..140: note = Description of Unknown:uncultivated organism with predicted taxonomy: unclassifiedVerrucomicrobia (miscellaneous)
  REGION 1..140: note = MG1-269 RuvC-III domain

SEQ ID NO: 2088 - protein, 138 aa, unidentified; identical to SEQ ID NO: 1921
  REGION 1..138: note = Description of Unknown:uncultivated organism with predicted taxonomy: Verrucomicrobia
  REGION 1..138: note = MG1-270 RuvC-III domain

SEQ ID NO: 2089 - protein, 140 aa, unidentified; identical to SEQ ID NO: 1908
  REGION 1..140: note = Description of Unknown:uncultivated organism with predicted taxonomy: unclassifiedVerrucomicrobia (miscellaneous)
  REGION 1..140: note = MG1-271 RuvC-III domain

SEQ ID NO: 2090 - protein, 203 aa, unidentified
  REGION 1..203: note = Description of Unknown:uncultivated organism
  REGION 1..203: note = MG1-272 RuvC-III domain
QRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHK

SEQ ID NO: 2091 - protein, 198 aa, unidentified
  REGION 1..198: note = Description of Unknown:uncultivated organism with predicted taxonomy: Rhizobiales
  REGION 1..198: note = MG1-273 RuvC-III domain
QQTAYIARCLREACLIIFGKEWLDWTDGAGRDPRLLTDNRASKNYLTTNGVITSRLRGAWHLNEVLWPKPERLNDTEWDKLTDDEKIPLKAKYKEERELRALKNRQDHRHHAIDAMVISCAMPWQTCKTRTGSQQSDDGLCEVDSETGAITKIWNPVFNDYGYGIKQAAEAKSALLLKFSSERQVDLLRHHKSNNRNA

SEQ ID NO: 2092 - protein, 198 aa, unidentified
  REGION 1..198: note = Description of Unknown:uncultivated organism
  REGION 1..198: note = MG1-274 RuvC-III domain
QQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNA

SEQ ID NO: 2093 - protein, 125 aa, unidentified; identical to SEQ ID NO: 1839
  REGION 1..125: note = Description of Unknown:uncultivated organism
  REGION 1..125: note = MG1-275 RuvC-III domain

SEQ ID NO: 2094 - protein, 123 aa, unidentified
  REGION 1..123: note = Description of Unknown:uncultivated organism with predicted taxonomy: Verrucomicrobiabacterium IMCC26134
  REGION 1..123: note = MG1-276 RuvC-III domain
AETAWISKLAQTIVGLRFGWPGGIVDGKRKVIVVSGGLTGRIRRKYKLNRLLNPNASSEEEAETKNRDDDRHHALDAMVISFIPNWTRNAKLAGFFRFPEGVHGEFFANEIADVVPKNVALEK

SEQ ID NO: 2095 - protein, 174 aa, unidentified
  REGION 1..174: note = Description of Unknown:uncultivated organism
  REGION 1..174: note = MG1-277 RuvC-III domain
QHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKR

SEQ ID NO: 2096 - protein, 166 aa, unidentified
  REGION 1..166: note = Description of Unknown:uncultivated organism
  REGION 1..166: note = MG1-279 RuvC-III domain
QHTAYIARVIRHISLIQLGWLNDAGRDPTPEKQNPALSFQVTNGQLTSRLRKSWGLNQILHPLPPGKRWDELTDEEQTQFTEKNRGDLRHHSLDAMVIACTLPWLAHRTHGATDQFGHHGWWTQDEKQRSKAANPLFPNEGQMHDVVKKEIEKVIVRHHVSRSNHK

SEQ ID NO: 2097 - protein, 203 aa, unidentified; identical to SEQ ID NO: 2090
  REGION 1..203: note = Description of Unknown:uncultivated organism
  REGION 1..203: note = MG1-280 RuvC-III domain

SEQ ID NO: 2098 - protein, 174 aa, unidentified; identical to SEQ ID NO: 2095
  REGION 1..174: note = Description of Unknown:uncultivated organism with predicted taxonomy:Thermoflexibacter ruber
  REGION 1..174: note = MG1-281 RuvC-III domain

SEQ ID NO: 2099 - protein, 174 aa, unidentified; identical to SEQ ID NO: 2095
  REGION 1..174: note = Description of Unknown:uncultivated organism
  REGION 1..174: note = MG1-282 RuvC-III domain

SEQ ID NO: 2100 - protein, 137 aa, unidentified
  REGION 1..137: note = Description of Unknown:uncultivated organism with predicted taxonomy: Verrucomicrobiabacterium IMCC26134
  REGION 1..137: note = MG1-283 RuvC-III domain
AETAWVSKLAQTIANLRFNWTNGYDQNRKKRVIVISGGVTARVRRKYGLDKLLYNKDTDAEVFAKKLKNRADKRHHALDAMVLTFVPQWARDPGKEGFFRFPAEFRDANGREDYEQIRKLFGDSIAKVMPRYLTYER

SEQ ID NO: 2101 - protein, 172 aa, unidentified
  REGION 1..172: note = Description of Unknown:uncultivated organism
  REGION 1..172: note = MG1-284 RuvC-III domain
QHTAYIARVIRQVSLIQLGWLAEDGRDATGLKDPEMTAWRFQVTNGSLTSRLRKSWGLNQILNPFPSKDAWEAMTPEEQEKKKTEMQEKNRGDLRHHSLDAMVIACTLPWLAHRTHGAKDSFGRPGWWWLDEKKRSQASTPIFPKEGQMHEVVKKEIEKVLVRHHVSRSNHQ

SEQ ID NO: 2102 - protein, 127 aa, unidentified
  REGION 1..127: note = Description of Unknown:uncultivated organism with predicted taxonomy: Verrucomicrobia
  REGION 1..127: note = MG1-285 RuvC-III domain
AETAWIAKLAQAIVGLHFGWRNGVDESGNKRVTVISGGLTGRIRRKYALNQILNPNAKTEEEAEKKNRDDDRHHALDAMVISFIPSWVRDAMKEKFFRFPEPIHQNAKGFFEKEIQSVKPRNIALQK

SEQ ID NO: 2103 - protein, 137 aa, unidentified; identical to SEQ ID NO: 1831
  REGION 1..137: note = Description of Unknown:uncultivated organism with predicted taxonomy: Verrucomicrobia
  REGION 1..137: note = MG1-287 RuvC-III domain

SEQ ID NO: 2104 - protein, 137 aa, unidentified; identical to SEQ ID NO: 1831
  REGION 1..137: note = Description of Unknown:uncultivated organism
  REGION 1..137: note = MG1-288 RuvC-III domain

SEQ ID NO: 2105 - protein, 146 aa, unidentified
  REGION 1..146: note = Description of Unknown:uncultivated organism with predicted taxonomy:Deltaproteobacteria bacterium RIFOXYA12_FULL_61_11
  REGION 1..146: note = MG1-290 RuvC-III domain
TQTAYIARALRGLCLLRQNWLTPEGRDPSDQPGGPGQFFQLTNGYLTAGIRRCWGLDELLPSALDDEGGKNRHDLRHHALDAAVIACTLPWAAHQPLSRGGWREAPPFGSARREQWRTPFDHLRSQIRARVPDIVPTQKVGTSAKQ

SEQ ID NO: 2106 - protein, 126 aa, unidentified
  REGION 1..126: note = Description of Unknown:uncultivated organism with predicted taxonomy: CandidatusTermititenax aidoneus
  REGION 1..126: note = MG1-291 RuvC-III domain
AETAYITKLTQKIAHLFFGWDWQTKGSHRKIIVQSGGYTSKIRKIFKLNALLYPEKTGDEIREIVETGKNRDNKRHHALDALVLSITPEIKYDEKKDADVYPVWFNPEYCKNALDKVNPTYIDFEK

SEQ ID NO: 2107 - protein, 133 aa, unidentified
  REGION 1..133: note = Description of Unknown:uncultivated organism with predicted taxonomy: CandidatusTermititenax aidoneus
  REGION 1..133: note = MG1-292 RuvC-III domain
SQTAYISKLAQKVTALTFGWGMQTKDDNRNIVIATGGQTARIRSRFKLDRLLHSGMTDEEFEKALRNGEIEKKNRSNPRHHALDALVLSAVPEIRVDKNRKGKYDDIYPSWLTRDFCEKEVAHVYPKQIKFSK

SEQ ID NO: 2108 - protein, 133 aa, unidentified; identical to SEQ ID NO: 2107
  REGION 1..133: note = Description of Unknown:uncultivated organism with predicted taxonomy: Elusimicrobiabacterium HGW-Elusimicrobia-1
  REGION 1..133: note = MG1-293 RuvC-III domain

SEQ ID NO: 2109 - protein, 129 aa, unidentified
  REGION 1..129: note = Description of Unknown:uncultivated organism with predicted taxonomy: Endomicrobiumproavitum
  REGION 1..129: note = MG1-294 RuvC-III domain
QATSQIEKEAQTIASLLFGWGINTKGDKKKILFFTGGNTADVRKNLNLNRLLHPALSDEEYNELKKKKDFKDKNRKNTKHHALDALVLSVLPEITMDKKSIENKPEFFNIKFCEEQLKKVYPIIIKQTK

SEQ ID NO: 2110 - protein, 124 aa, unidentified
  REGION 1..124: note = Description of Unknown:uncultivated organism with predicted taxonomy: Verrucomicrobiabacterium 12-59-8
  REGION 1..124: note = MG1-295 RuvC-III domain
AETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPK

SEQ ID NO: 2111 - protein, 129 aa, unidentified
  REGION 1..129: note = Description of Unknown:uncultivated organism
  REGION 1..129: note = MG1-296 RuvC-III domain
QATMYIEKYAQKITALFFGWGEQTKGDERHIFVCNGGLTAKLRKENGLDRLLWSEEEFYKLMASGKLDEKNRENKKHHALDALVISFADDLRTDPKTGRKLFPEFAQNNPAFFSEAMDKVFPKQLRKKA

SEQ ID NO: 2112 - protein, 124 aa, unidentified; identical to SEQ ID NO: 2110
  REGION 1..124: note = Description of Unknown:uncultivated organism with predicted taxonomy: Verrucomicrobiabacterium 12-59-8
  REGION 1..124: note = MG1-297 RuvC-III domain

SEQ ID NO: 2113 - protein, 130 aa, unidentified
  REGION 1..130: note = Description of Unknown:uncultivated organism
  REGION 1..130: note = MG1-298 RuvC-III domain
QATRYIEKLAQKLISLYFGWGEQTTGDKRKMFVCTGGLTAKIRSQYGLNRLLHKDLSGEEFKKIVAEGKLDEKNRNNKRHHALDALVISFTRDIKYDNKGKPVLPDYACNPAFFADAIEKVFPVTIRSKK

SEQ ID NO: 2114 - protein, 127 aa, unidentified
  REGION 1..127: note = Description of Unknown:uncultivated organism
  REGION 1..127: note = MG1-299 RuvC-III domain
AETAWISRLAQKIADLSFGWKNGIDAAGRKRTVVVSGGLTARIRRKYGLNRILNPGASSEEEAEKKNRSDKRHHALDAMTISFIPQWARDPGKTGFFRFPKAIRDNPLPFFQARIDAVVPRQLCYEK

SEQ ID NO: 2115 - protein, 127 aa, unidentified
  REGION 1..127: note = Description of Unknown:uncultivated organism
  REGION 1..127: note = MG1-300 RuvC-III domain
AETAWISRLSQKIIDLTFGWSNGVDASGRKRSIIVSGGLTARIRRKYHLNHILNPDAETDEEAEKKNRKDKRHHALDAMTISFIPQWARDPDKTGFFRLPKEIRDNPLPFFAKRIDTVIPRQLCFEK

SEQ ID NO: 2116 - protein, 127 aa, unidentified
  REGION 1..127: note = Description of Unknown:uncultivated organism
  REGION 1..127: note = MG1-301 RuvC-III domain
AETAWISRLAQKIADLTFGWQNGVDAAGRKRTIIVSGGLTARIRRKYGLNRLLNPDASSEEEAEKKNRSDKRHHALDAMTISFIPQWARDPDKTGFFRFPKEIRDNSLPFFKARIDAVVPRQLCYEK

SEQ ID NO: 2117 - protein, 127 aa, unidentified
  REGION 1..127: note = Description of Unknown:uncultivated organism
  REGION 1..127: note = MG1-302 RuvC-III domain
AETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEK

SEQ ID NO: 2118 - protein, 127 aa, unidentified; identical to SEQ ID NO: 2117
  REGION 1..127: note = Description of Unknown:uncultivated organism
  REGION 1..127: note = MG1-303 RuvC-III domain

SEQ ID NO: 2119 - protein, 173 aa, unidentified
  REGION 1..173: note = Description of Unknown:uncultivated organism with predicted taxonomy: Verrucomicrobia
  REGION 1..173: note = MG1-304 RuvC-III domain
AATSWIARITQSIVRLHFGWQLDDEPGKEKVMTISGGLTARIRRKYLLDSLLGTDKESQKVCEQVDQVLAEMEKLKSQPRSEETKVQWRELSQKRSQLARDSEKNRGDQRHHALDAMLLTFLPNWARDRNKEDFLRLEDIGDNAPYTDEGKRNAEKITDEIKKLVEETKPIYK

SEQ ID NO: 2120 - protein, 127 aa, unidentified
  REGION 1..127: note = Description of Unknown:uncultivated organism with predicted taxonomy: Verrucomicrobiabacterium IMCC26134
  REGION 1..127: note = MG1-305 RuvC-III domain
AETAWISRLAQKIADLSFGWQNGVDAAGRKRTIVVSGGLTARIRRKYGLNRLLNPNATSEEEAEKKNRADKRHHALDAMTISFIPQWARDPDKTGFFRFPKEIRDNPHPFFQARIEAVVPRQLCYEK

SEQ ID NO: 2121 - protein, 123 aa, unidentified
  REGION 1..123: note = Description of Unknown:uncultivated organism with predicted taxonomy: Verrucomicrobia
  REGION 1..123: note = MG1-306 RuvC-III domain
AETAWISKLAQTIIGLRFGWPNGIANGERKVIVISGGLTGRIRRKYKLNSLLNPDAKSEEEAEIKNRGDDRHHALDAMVISFLPTWARNSRFTGFFRFPDEVTRELFKREIAEVIPQNVCFER

SEQ ID NO: 2122 - protein, 198 aa, unidentified
  REGION 1..198: note = Description of Unknown:uncultivated organism with predicted taxonomy: Verrucomicrobiabacterium IMCC26134
  REGION 1..198: note = MG1-307 RuvC-III domain
QQTAYIARCLREACLIHFGKEWLDWTDGAGRDPLLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNA

SEQ ID NO: 2123 - protein, 127 aa, unidentified
  REGION 1..127: note = Description of Unknown:uncultivated organism
  REGION 1..127: note = MG1-308 RuvC-III domain
QLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSK

SEQ ID NO: 2124 - protein, 152 aa, unidentified
  REGION 1..152: note = Description of Unknown:uncultivated organism
  REGION 1..152: note = MG1-309 RuvC-III domain
QLARELRRRVVEWLGIERRHAGIADPTQRALAREAEERRRVAAPAGALTAACREAWKDRLPEAYFTPIEIRGQTVLTKNRGNLRHHMWDAGVLAHIPPGDGLNHVRYGGIFETADIGGAPRPVPLPELAPDLAEIEKADPLACRVFHLRPRH

SEQ ID NO: 2125 - protein, 137 aa, unidentified
  REGION 1..137: note = Description of Unknown:uncultivated organism
  REGION 1..137: note = MG1-310 RuvC-III domain
QLARQLRAEIMRWMQVDDKPDEAARRIGTPSGWLAAQARKSWLPAEEYEKVRNNVTHHLIDAAILAHIPPREGMNSVPCKGIFYVESVPVRDPVTGDTTYRLETKALPELSPLPRLKHWLPDNGEYDVCPVWKPRRQ

SEQ ID NO: 2126 - protein, 137 aa, unidentified
  REGION 1..137: note = Description of Unknown:uncultivated organism
  REGION 1..137: note = MG1-311 RuvC-III domain
QLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQ

SEQ ID NO: 2127 - protein, 137 aa, unidentified; identical to SEQ ID NO: 2126
  REGION 1..137: note = Description of Unknown:uncultivated organism
  REGION 1..137: note = MG1-312 RuvC-III domain

SEQ ID NO: 2128 - protein, 127 aa, unidentified; identical to SEQ ID NO: 2123
  REGION 1..127: note = Description of Unknown:uncultivated organism
  REGION 1..127: note = MG1-314 RuvC-III domain

SEQ ID NO: 2129 - protein, 137 aa, unidentified
  REGION 1..137: note = Description of Unknown:uncultivated organism with predicted taxonomy: Verrucomicrobiabacterium
  REGION 1..137: note = MG1-315 RuvC-III domain
QLARQLRAEVMRWMHVEDQPDEAARRIGTPSGWLVAQARKSWLAASDYQKVRNNLTHHLIDAAVLAHIPPREGMNSIICKGIFYDVRERVRDEATGITSHRFLTKALPELSPLPRLKQWLPDNGEYAVCPVLKPRHQ

SEQ ID NO: 2130 - protein, 198 aa, unidentified; identical to SEQ ID NO: 2092
  REGION 1..198: note = Description of Unknown:uncultivated organism with predicted taxonomy: Thiorhodospirasibirica
  REGION 1..198: note = MG1-316 RuvC-III domain

SEQ ID NO: 2131 - protein, 137 aa, unidentified
  REGION 1..137: note = Description of Unknown:uncultivated organism
  REGION 1..137: note = MG1-317 RuvC-III domain
QLARQLRAEVMRWMKVEGDPDEAARRIGTPSGWLAAQARKSWLAQGDYEKVRNNLTHHLIDAAVLAHIPPREGMNSVLYKGIFYVVREPVRNEITGTTSQRLLTKALPQLSPLPRLNHWLPDNGEYAVCPVLKPRRQ

SEQ ID NO: 2132 - protein, 137 aa, unidentified; identical to SEQ ID NO: 2126
  REGION 1..137: note = Description of Unknown:uncultivated organism
  REGION 1..137: note = MG1-318 RuvC-III domain

SEQ ID NO: 2133 - protein, 130 aa, unidentified
  REGION 1..130: note = Description of Unknown:uncultivated organism with predicted taxonomy: Verrucomicrobiabacterium IMCC26134
  REGION 1..130: note = AKC83434.1 RuvC-III domain
AETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYER

SEQ ID NO: 2134 - protein, 130 aa, unidentified; identical to SEQ ID NO: 2133
  REGION 1..130: note = Description of Unknown:uncultivated organism with predicted taxonomy: Verrucomicrobiabacterium IMCC26134
  REGION 1..130: note = AKC83434.1 RuvC-III domain

SEQ ID NO: 2135 - protein, 123 aa, unidentified
  REGION 1..123: note = Description of Unknown:uncultivated organism with predicted taxonomy: Verrucomicrobiabacterium 61-8
  REGION 1..123: note = OJV06180.1 RuvC-III domain
AETAWIAKLSQAILDAFFGWKNGVDDEGRKRVISVNGGLTARIRRKYQLNSILNPSLNEEEAEKKNRSDKRHHALDAMVINFIPSWTRDTAKEHFFRFPSGIHRETFVQQIANVTPRNLCLEK

SEQ ID NO: 2136 - protein, 123 aa, unidentified; identical to SEQ ID NO: 2135
  REGION 1..123: note = Description of Unknown:uncultivated organism with predicted taxonomy: Verrucomicrobiabacterium 61-8
  REGION 1..123: note = OJV06180.1 RuvC-III domain

SEQ ID NO: 2137 - protein, 137 aa, unidentified
  REGION 1..137: note = Description of Unknown:uncultivated organism with predicted taxonomy: Pedosphaera sp.Tous-C6FEB
  REGION 1..137: note = PAW75411.1 RuvC-III domain
AETAWVSKLAQAIVNLTFGWTNANDEEGRKRVIVVSGGLTARVRRKYSLDKLLYTNTTDPEVLTKQVKNRSDKRHHALDAMVLTYIPQWARDPGKEGFFRFPAEFRDATGREDYSAIQRLFKDKLAKTTPRFLAYER

SEQ ID NO: 2138 - protein, 137 aa, unidentified; identical to SEQ ID NO: 2137
  REGION 1..137: note = Description of Unknown:uncultivated organism with predicted taxonomy: Pedosphaera sp.Tous-C6FEB
  REGION 1..137: note = PAW75411.1 RuvC-III domain

SEQ ID NO: 2139 - protein, 130 aa, unidentified; identical to SEQ ID NO: 2133
  REGION 1..130: note = Description of Unknown:uncultivated organism with predicted taxonomy: Verrucomicrobiabacterium IMCC26134
  REGION 1..130: note = WP_082083265.1 RuvC-III domain

SEQ ID NO: 2140 - protein, 130 aa, unidentified; identical to SEQ ID NO: 2133
  REGION 1..130: note = Description of Unknown:uncultivated organism with predicted taxonomy: Verrucomicrobiabacterium IMCC26134
  REGION 1..130: note = WP_082083265.1 RuvC-III domain

SEQ ID NO: 2141 - protein, 156 aa, unidentified; identical to SEQ ID NO: 1899
  REGION 1..156: note = Description of Unknown:uncultivated organism
  REGION 1..156: note = MG2-1 RuvC-III domain

SEQ ID NO: 2142 - protein, 174 aa, unidentified
  REGION 1..174: note = Description of Unknown:uncultivated organism
  REGION 1..174: note = MG2-7 RuvC-III domain
TQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIP

SEQ ID NO: 2143 - protein, 206 aa, unidentified
  REGION 1..206: note = Description of Unknown:uncultivated organism
  REGION 1..206: note = MG2-3 RuvC-III domain
TITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTP

SEQ ID NO: 2144 - protein, 161 aa, unidentified
  REGION 1..161: note = Description of Unknown:uncultivated organism with predicted taxonomy: Verrucomicrobia
  REGION 1..161: note = MG2-5 RuvC-III domain
TQTSQLVRLAAQALRRNLPHLGPENVVSLPGSVTGMVRKSWNVTGCLELACPQVMEEVVDQDGKAVRRAKDKGEIRGITHLHHALDACVIGFSSHFIPNNGGLWELMVKRRWTPAEEKELEARRVFSKGMDGRFQMTDLHKRHKEAIRQRLAEKRVVQHIP

SEQ ID NO: 2145 - protein, 153 aa, unidentified
  REGION 1..153: note = Description of Unknown:uncultivated organism with predicted taxonomy: Verrucomicrobiabacterium
  REGION 1..153: note = MG2-6 RuvC-III domain
TQTSQLVRLAAQVIRKKYVDSKEPKIVSMPGSVTAVFRKSWKVMGCLSKAVPAILDENGEVRPKDEIRNITHLHHAIDACVLALASHLFPNNGRLWELLVKNKLNSSEVDELKKIPLVQVGVDNKINISDLPEFIKEQISNRLLERRVVQHIS

SEQ ID NO: 2146 - protein, 154 aa, unidentified
  REGION 1..154: note = Description of Unknown:uncultivated organism with predicted taxonomy: Verrucomicrobia
  REGION 1..154: note = MG2-8 RuvC-III domain
TVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIP

SEQ ID NO: 2147 - protein, 154 aa, unidentified; identical to SEQ ID NO: 2146
  REGION 1..154: note = Description of Unknown:uncultivated organism with predicted taxonomy: Verrucomicrobia
  REGION 1..154: note = MG2-10 RuvC-III domain

SEQ ID NO: 2148 - protein, 156 aa, unidentified
  REGION 1..156: note = Description of Unknown:uncultivated organism
  REGION 1..156: note = MG2-11 RuvC-III domain
TQTSQLVRLGAQILKKGFTGLERQPVITSMPGSVTGVMRKGWNLIGCLSAANPNVLDEIGQPKIKTEIRDITHLHHALDACVLVLASYFIPNKGAVWELIVKRRLDETEQLQLRTATRGIFNFSPGRRFGLADLPNSLKEQIRQRLAERRVVQHVP

SEQ ID NO: 2149 - protein, 28 aa, unidentified
  REGION 1..28: note = Description of Unknown:uncultivated organism with predicted taxonomy: Verrucomicrobiabacterium
  REGION 1..28: note = MG2-12 RuvC-III domain
TKTRFINKLAAQQLQAAFRDLPEQQRPP

SEQ ID NO: 2150 - protein, 156 aa, unidentified
  REGION 1..156: note = Description of Unknown:uncultivated organism with predicted taxonomy: Verrucomicrobiabacterium
  REGION 1..156: note = MG2-13 RuvC-III domain
TQTSQLVRLGAQVLKKGFTGLERQPVITSMPGSVTGVMRKGWNLIGCLSAANPNVLDEIGQPKIKTEIRDITHLHHALDACVLALVSHFIPNNGGVWELIVKRRLDETEQLQLRAATHGIFNFSPGRRFGLADLPDSLKEQIRQRLAERRVVQHVP

SEQ ID NO: 2151 - protein, 156 aa, unidentified
  REGION 1..156: note = Description of Unknown:uncultivated organism with predicted taxonomy: Verrucomicrobiabacterium
  REGION 1..156: note = MG2-14 RuvC-III domain
SQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNP

SEQ ID NO: 2152 - protein, 156 aa, unidentified; identical to SEQ ID NO: 2151
  REGION 1..156: note = Description of Unknown:uncultivated organism with predicted taxonomy: Verrucomicrobiabacterium
  REGION 1..156: note = MG2-15 RuvC-III domain

SEQ ID NO: 2153 - protein, 153 aa, unidentified
  REGION 1..153: note = Description of Unknown:uncultivated organism with predicted taxonomy: Verrucomicrobiabacterium
  REGION 1..153: note = MG2-16 RuvC-III domain
TQTSQLARMAAQMVKRTFQDVEQKPVIVSMPGSVTSTVRKGWDLLGCLSKACPEVLDETGQVKTKSEIRDITHLHHALDACVLGLAAHFIPNNGDIWKLIIKQDLNETEKDLLRPLGIFDIGEKRFRLKDLPNELKNQLRERLAELRVVQHIP

SEQ ID NO: 2154 - protein, 206 aa, unidentified; identical to SEQ ID NO: 2143
  REGION 1..206: note = Description of Unknown:uncultivated organism
  REGION 1..206: note = MG2-17 RuvC-III domain

SEQ ID NO: 2155 - protein, 153 aa, unidentified
  REGION 1..153: note = Description of Unknown:uncultivated organism with predicted taxonomy: Verrucomicrobia
  REGION 1..153: note = MG2-18 RuvC-III domain
TQTSQLVRLGAQMLKRPFLREKHQPVITSMPGSVTGEVRKGWNLLGCLSKACPQVLDENGEVRTKTEIREITHLHHALDACVLGLAAHFIPNNGRIWELIVKRNLTDTEKLQLRALGIFDFSPEGFRLKELPDELKNQIRERLAERRVVQHVP

SEQ ID NO: 2156 - protein, 156 aa, unidentified
  REGION 1..156: note = Description of Unknown:uncultivated organism with predicted taxonomy: Verrucomicrobia
  REGION 1..156: note = MG2-19 RuvC-III domain
TQTSQLVRLAVQVLKKKYIGEKEKPVFVSMPGSITGKFRAAWNLLGCLLKAVPWAADEDNQVKPKDELRNITHLHHAIDACVLALAGHFIPTYKNGKVWELMIKGTVKPSEKSYIEDVPMLQLDSENRLHIKDLPDSIKEQITERLYERRVVQHIP

SEQ ID NO: 2157 - protein, 189 aa, unidentified
  REGION 1..189: note = Description of Unknown:uncultivated organism with predicted taxonomy: Verrucomicrobiabacterium
  REGION 1..189: note = MG2-20 RuvC-III domain
TVTSHLVRLGAQVLQRAFPPEQRPPVISLPGSVTGEVRKAWKVTACLEAANPAVMEVVEEPDPQTGEMRRIRRAKKKEDIRGITHLHHALDACVLGLASLYFPRHGAVWSAAVKAGQHAATEYDNNEHPLWQAMTKRRPTAQEVVLLKATGLYDGPDSNGRMQLRDLPAELKGQIRRRLAEKRVVQHIP

SEQ ID NO: 2158 - protein, 156 aa, unidentified
  REGION 1..156: note = Description of Unknown:uncultivated organism
  REGION 1..156: note = MG2-21 RuvC-III domain
TQTSQLVRLAVQVLMKKYIGEKEKPVFVSMPGSITGKFRAGWNLLGCLLKAVPWAADEDNQVKPKDELRNITHLHHAIDACVLALAAHFIPTYKNGKVWELMFKGTVKPSEKMYIEDVPVLQLDSENRLHIKDLPDSIKEQITERLYERRVVQHIP

SEQ ID NO: 2159 - protein, 206 aa, unidentified; identical to SEQ ID NO: 2143
  REGION 1..206: note = Description of Unknown:uncultivated organism
  REGION 1..206: note = MG2-22 RuvC-III domain

SEQ ID NO: 2160 - protein, 152 aa, unidentified
  REGION 1..152: note = Description of Unknown:uncultivated organism with predicted taxonomy: Verrucomicrobiabacterium
  REGION 1..152: note = MG2-23 RuvC-III domain
TQTSQLVRLGAQMLKRPFLGEKHQPVITSLPGSVTGVVRKGWNLLGCLSKACPQVLDETGEVRTKTDIREITHLHHAVDACVLGLAAHFVPNNGRMELIVKRNLTETEKLQLRALGVFDFSPDGFRLKELPEGLKNQIRDRLAERRVVQHIP

SEQ ID NO: 2161 - protein, 185 aa, unidentified
  REGION 1..185: note = Description of Unknown:uncultivated organism with predicted taxonomy: Verrucomicrobiabacterium
  REGION 1..185: note = MG2-24 RuvC-III domain
TVTSHLVRLGAQVLQRVFPKDQRPPVVSLPGSVTGEVRKAWRLTGCLEAANPAVMEEVQERNPDTGELQTVRRPKKKDEIRGITHLHHALDACVLGLASLCFPRHGAVWSAMVKAGGDREADDDRRLWLAMTKRRPTPQEATLLKATGRYQQDSEGRLHLADLDEQLKQQIRARLAEKRVVQHVP

SEQ ID NO: 2162 - protein, 175 aa, unidentified
  REGION 1..175: note = Description of Unknown:uncultivated organism
  REGION 1..175: note = MG2-25 RuvC-III domain
TLTSQLVRLGAQVIKRFFAGGARVNNPREAPTDSTARGFVNPRSGPRITSLPGAVTGAVRKGWRVLGCLAQAAPQILEPTGEPKSKTDIRDLTHLHHALDACVLALAAHYFPKDGSLWEAMIVRAPNAAQKQLLHATGFYEFIAEDKPNLKDLPIELKQQIANRLAEKRVVQHIP

SEQ ID NO: 2163 - protein, 156 aa, unidentified
  REGION 1..156: note = Description of Unknown:uncultivated organism with predicted taxonomy: Verrucomicrobiabacterium
  REGION 1..156: note = MG2-26 RuvC-III domain
TQTSQLVRLGAQVLQRAYLGLARPPVVTSLPGSVTGTVRKGWDLLGCLATANPGVLDESGEVKNKTEIRDITHLHHALDACVLALAARAIPNNGRVWELLTRRDNGLNEVERQQLLALGIYARDSEGRLVLRDLSPDLNEQVRQRLAERRVVQHIP

SEQ ID NO: 2164 - protein, 161 aa, unidentified
  REGION 1..161: note = Description of Unknown:uncultivated organism
  REGION 1..161: note = MG2-27 RuvC-III domain
TQTSHLVRLAAEELKKEFGGVQCSTRIVSMPGSVTAETRKAWKLEACLAQANPEVAELRERRKTEPAPVSIKQELRDISHLHHALDACVLACAAHYLEKKGNIWKALVQRRKSEAENLELLSTGLFKRGQDGQARLQDLPAQLKNQISRVLAECRVVQHIP

SEQ ID NO: 2165 - protein, 154 aa, unidentified
  REGION 1..154: note = Description of Unknown:uncultivated organism with predicted taxonomy: Verrucomicrobia
  REGION 1..154: note = MG2-28 RuvC-III domain
TQTSQLARLAAQILRTPFNDTSNPPEIVSLPGFVTATVRRSWDVLGCLSQAAPGVLNTDGSTRSKTEIRNITHLHHALDACVIGLASHFIPNRGDVWRLLAQRNLRAWEKQQLADLGVFDFDAHGGLRLRDLPQQLKEQLRQRLTERRVVQHVP

SEQ ID NO: 2166 - protein, 152 aa, unidentified
  REGION 1..152: note = Description of Unknown:uncultivated organism with predicted taxonomy: Verrucomicrobiabacterium
  REGION 1..152: note = MG2-29 RuvC-III domain
TISSYVAKLAVGQIKKEFSELSKKPPVISLPGRLTGEARKSWKLLGLLSAVNENITSETPKNDIRGLTHLHHAMDAAVMGLMAHCADNLSDGTSWQLLLKRNLRPEEKNLLKANMRNIGFDGNRAHLLDVPNEIKEQLRRCLLERRVVQHVP

SEQ ID NO: 2167 - protein, 153 aa, unidentified
  REGION 1..153: note = Description of Unknown:uncultivated organism with predicted taxonomy: Verrucomicrobiabacterium
  REGION 1..153: note = MG2-30 RuvC-III domain
TLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVP

SEQ ID NO: 2168 - protein, 153 aa, unidentified; identical to SEQ ID NO: 2167
  REGION 1..153: note = Description of Unknown:uncultivated organism with predicted taxonomy: Verrucomicrobiabacterium
  REGION 1..153: note = MG2-31 RuvC-III domain

SEQ ID NO: 2169 - protein, 153 aa, unidentified; identical to SEQ ID NO: 2167
  REGION 1..153: note = Description of Unknown:uncultivated organism with predicted taxonomy: Verrucomicrobiabacterium
  REGION 1..153: note = MG2-32 RuvC-III domain

SEQ ID NO: 2170 - protein, 66 aa, unidentified
  REGION 1..66: note = Description of Unknown:uncultivated organism with predicted taxonomy: Verrucomicrobiabacterium
  REGION 1..66: note = MG2-33 RuvC-III domain
TLTSYVTKLALQQIKNQFDTCRKKPQVIALPGRLTGETRKTWKLMGLLHVVNEKIDGKTLKNDIRS

SEQ ID NO: 2171 - protein, 66 aa, unidentified; identical to SEQ ID NO: 2170
  REGION 1..66: note = Description of Unknown:uncultivated organism with predicted taxonomy: Verrucomicrobiabacterium
  REGION 1..66: note = MG2-34 RuvC-III domain

SEQ ID NO: 2172 - protein, 156 aa, unidentified
  REGION 1..156: note = Description of Unknown:uncultivated organism with predicted taxonomy: Thermoguttaterrifontis
  REGION 1..156: note = MG2-35 RuvC-III domain
TQTSYLNKLAAQQVQRWFSDQLDEDVKLPPVVQLSGSVTAAVRRSWDLFDQLQQVCPETRGKSKSDIRGMTHLHHALDAVTVGLAAHLFPKDGHLWALMSKRKITRPSDRDYMRSRLGDLVSFNNDGKWRLEALPESLLFEVAGKLAEQRVVRHMP

SEQ ID NO: 2173 - protein, 157 aa, unidentified
  REGION 1..157: note = Description of Unknown:uncultivated organism with predicted taxonomy:Coraliomargarita sp. CAG:312
  REGION 1..157: note = MG2-36 RuvC-III domain
TQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2174 - protein, 94 aa, unidentified
  REGION 1..94: note = Description of Unknown:uncultivated organism with predicted taxonomy:Coraliomargarita sp. CAG:312
  REGION 1..94: note = MG2-37 RuvC-III domain
TQTSHLNKLAFKVVDSLYVDSEEKPELVHLPGSVTSVLRTNWDLSACMAKACPEIIVTVKSADSASGERGMGGDGLPQGLNGSVTDTAACCGGE

SEQ ID NO: 2175 - protein, 157 aa, unidentified
  REGION 1..157: note = Description of Unknown:uncultivated organism with predicted taxonomy:Coraliomargarita sp. CAG:312
  REGION 1..157: note = MG2-38 RuvC-III domain
TQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2176 - protein, 202 aa, unidentified
  REGION 1..202: note = Description of Unknown:uncultivated organism with predicted taxonomy: Verrucomicrobiabacterium
  REGION 1..202: note = MG2-39 RuvC-III domain
TQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLP

SEQ ID NO: 2177 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-40 RuvC-III domain

SEQ ID NO: 2178 - protein, 202 aa, unidentified; identical to SEQ ID NO: 2176
  REGION 1..202: note = Description of Unknown:uncultivated organism with predicted taxonomy:Coraliomargarita sp. CAG:312
  REGION 1..202: note = MG2-41 RuvC-III domain

SEQ ID NO: 2179 - protein, 202 aa, unidentified; identical to SEQ ID NO: 2176
  REGION 1..202: note = Description of Unknown:uncultivated organism with predicted taxonomy:Coraliomargarita sp. CAG:312
  REGION 1..202: note = MG2-42 RuvC-III domain

SEQ ID NO: 2180 - protein, 202 aa, unidentified; identical to SEQ ID NO: 2176
  REGION 1..202: note = Description of Unknown:uncultivated organism with predicted taxonomy: Verrucomicrobia
  REGION 1..202: note = MG2-43 RuvC-III domain

SEQ ID NO: 2181 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-44 RuvC-III domain

SEQ ID NO: 2182 - protein, 202 aa, unidentified; identical to SEQ ID NO: 2176
  REGION 1..202: note = Description of Unknown:uncultivated organism with predicted taxonomy:Coraliomargarita sp. CAG:312
  REGION 1..202: note = MG2-45 RuvC-III domain

SEQ ID NO: 2183 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-46 RuvC-III domain

SEQ ID NO: 2184 - protein, 202 aa, unidentified; identical to SEQ ID NO: 2176
  REGION 1..202: note = Description of Unknown:uncultivated organism with predicted taxonomy: Verrucomicrobiabacterium
  REGION 1..202: note = MG2-47 RuvC-III domain

SEQ ID NO: 2185 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-48 RuvC-III domain

SEQ ID NO: 2186 - protein, 202 aa, unidentified; identical to SEQ ID NO: 2176
  REGION 1..202: note = Description of Unknown:uncultivated organism with predicted taxonomy:Coraliomargarita sp. CAG:312
  REGION 1..202: note = MG2-49 RuvC-III domain

SEQ ID NO: 2187 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-50 RuvC-III domain

SEQ ID NO: 2188 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-51 RuvC-III domain

SEQ ID NO: 2189 - protein, 202 aa, unidentified; identical to SEQ ID NO: 2176
  REGION 1..202: note = Description of Unknown:uncultivated organism with predicted taxonomy: Verrucomicrobiabacterium
  REGION 1..202: note = MG2-52 RuvC-III domain

SEQ ID NO: 2190 - protein, 202 aa, unidentified; identical to SEQ ID NO: 2176
  REGION 1..202: note = Description of Unknown:uncultivated organism with predicted taxonomy: Verrucomicrobiabacterium
  REGION 1..202: note = MG2-53 RuvC-III domain

SEQ ID NO: 2191 - protein, 135 aa, unidentified
  REGION 1..135: note = Description of Unknown:uncultivated organism with predicted taxonomy:Coraliomargarita sp. CAG:312
  REGION 1..135: note = MG2-54 RuvC-III domain
TQTSHLNKLAFKLVKSLYVDAGKTPELVHLPGSVTSAVRKNWELLPCMGDVCPEIYETLENGDKVLLLKDKIRSITHLHHAVDAVAMGLAASVFPRTKRFYEAVSKRHLSEADREELLNTGLVLFSDDKWKLVEL

SEQ ID NO: 2192 - protein, 157 aa, unidentified; identical to SEQ ID NO: 2175
  REGION 1..157: note = Description of Unknown:uncultivated organism with predicted taxonomy:Coraliomargarita sp. CAG:312
  REGION 1..157: note = MG2-55 RuvC-III domain

SEQ ID NO: 2193 - protein, 157 aa, unidentified
  REGION 1..157: note = Description of Unknown:uncultivated organism with predicted taxonomy:Coraliomargarita sp. CAG:312
  REGION 1..157: note = MG2-56 RuvC-III domain
TQTSHLNKLAFKVVKSLYADAEKAPELIHVPGIVTSVVRKNWNLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2194 - protein, 202 aa, unidentified; identical to SEQ ID NO: 2176
  REGION 1..202: note = Description of Unknown:uncultivated organism with predicted taxonomy:Coraliomargarita sp. CAG:312
  REGION 1..202: note = MG2-57 RuvC-III domain

SEQ ID NO: 2195 - protein, 202 aa, unidentified; identical to SEQ ID NO: 2176
  REGION 1..202: note = Description of Unknown:uncultivated organism with predicted taxonomy: Verrucomicrobiabacterium
  REGION 1..202: note = MG2-58 RuvC-III domain

SEQ ID NO: 2196 - protein, 157 aa, unidentified; identical to SEQ ID NO: 2175
  REGION 1..157: note = Description of Unknown:uncultivated organism with predicted taxonomy:Coraliomargarita sp. CAG:312
  REGION 1..157: note = MG2-59 RuvC-III domain

SEQ ID NO: 2197 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-60 RuvC-III domain

SEQ ID NO: 2198 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-61 RuvC-III domain

SEQ ID NO: 2199 - protein, 155 aa, unidentified
  REGION 1..155: note = Description of Unknown:uncultivated organism with predicted taxonomy: Verrucomicrobia
  REGION 1..155: note = MG2-62 RuvC-III domain
TQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVP

SEQ ID NO: 2200 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-63 RuvC-III domain

SEQ ID NO: 2201 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-64 RuvC-III domain

SEQ ID NO: 2202 - protein, 202 aa, unidentified; identical to SEQ ID NO: 2176
  REGION 1..202: note = Description of Unknown:uncultivated organism with predicted taxonomy:Coraliomargarita sp. CAG:312
  REGION 1..202: note = MG2-65 RuvC-III domain

SEQ ID NO: 2203 - protein, 157 aa, unidentified; identical to SEQ ID NO: 2175
  REGION 1..157: note = Description of Unknown:uncultivated organism with predicted taxonomy:Coraliomargarita sp. CAG:312
  REGION 1..157: note = MG2-66 RuvC-III domain

SEQ ID NO: 2204 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-67 RuvC-III domain

SEQ ID NO: 2205 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-68 RuvC-III domain

SEQ ID NO: 2206 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-69 RuvC-III domain

SEQ ID NO: 2207 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-70 RuvC-III domain

SEQ ID NO: 2208 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-71 RuvC-III domain

SEQ ID NO: 2209 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-72 RuvC-III domain

SEQ ID NO: 2210 - protein, 202 aa, unidentified; identical to SEQ ID NO: 2176
  REGION 1..202: note = Description of Unknown:uncultivated organism with predicted taxonomy: Verrucomicrobiabacterium
  REGION 1..202: note = MG2-73 RuvC-III domain

SEQ ID NO: 2211 - protein, 155 aa, unidentified; identical to SEQ ID NO: 2199
  REGION 1..155: note = Description of Unknown:uncultivated organism with predicted taxonomy: Verrucomicrobia
  REGION 1..155: note = MG2-74 RuvC-III domain

SEQ ID NO: 2212 - protein, 157 aa, unidentified; identical to SEQ ID NO: 2173
  REGION 1..157: note = Description of Unknown:uncultivated organism with predicted taxonomy:Coraliomargarita sp. CAG:312
  REGION 1..157: note = MG2-75 RuvC-III domain

SEQ ID NO: 2213 - protein, 136 aa, unidentified
  REGION 1..136: note = Description of Unknown:uncultivated organism with predicted taxonomy: Verrucomicrobiabacterium
  REGION 1..136: note = MG2-76 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPDR

SEQ ID NO: 2214 - protein, 154 aa, unidentified
  REGION 1..154: note = Description of Unknown:uncultivated organism
  REGION 1..154: note = MG2-77 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIP

SEQ ID NO: 2215 - protein, 154 aa, unidentified; identical to SEQ ID NO: 2214
  REGION 1..154: note = Description of Unknown:uncultivated organism with predicted taxonomy: Verrucomicrobiabacterium
  REGION 1..154: note = MG2-78 RuvC-III domain

SEQ ID NO: 2216 - protein, 154 aa, unidentified
  REGION 1..154: note = Description of Unknown:uncultivated organism with predicted taxonomy: Verrucomicrobiabacterium
  REGION 1..154: note = MG2-79 RuvC-III domain
TQTSQLVRLGGQVLKRAFANSEEKPTLVSLPGSVTGAVRKAWKVLGCLSLANQQVLDENGDVKTKTDIRDITHLHHALDACVLGLTSHFIPNNGRVWELIVKRNPNDLERQQLMALGVFGFNAEKRFEMRDLDNKLKEQIRQRLAEKRVVQHIP

SEQ ID NO: 2217 - protein, 154 aa, unidentified; identical to SEQ ID NO: 2214
  REGION 1..154: note = Description of Unknown:uncultivated organism with predicted taxonomy: Verrucomicrobiabacterium
  REGION 1..154: note = MG2-80 RuvC-III domain

SEQ ID NO: 2218 - protein, 110 aa, unidentified
  REGION 1..110: note = Description of Unknown:uncultivated organism with predicted taxonomy: Verrucomicrobiabacterium
  REGION 1..110: note = MG2-81 RuvC-III domain
TVTSQLVRLGAQIIKKTFAGSEKPPMVVSLPGSVTGTVRKGWNLLGCLELAAPQVKEADGGIKNKTDIRDVTHLHHALDACVLGLASYYLPNNGGLWEVMIKRNPNDGEK

SEQ ID NO: 2219 - protein, 154 aa, unidentified
  REGION 1..154: note = Description of Unknown:uncultivated organism with predicted taxonomy: Verrucomicrobiabacterium
  REGION 1..154: note = MG2-82 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLKDLKPERKEQIRQRLAERRVVQHIP

SEQ ID NO: 2220 - protein, 157 aa, unidentified
  REGION 1..157: note = Description of Unknown:uncultivated organism
  REGION 1..157: note = MG2-83 RuvC-III domain
TQTSQLVRLGAQVLKKNLPHLTTGDVTSLPGSVTGTVRKGWKLEACLGLANPQVFDGNGGAKTKTEIRDITHLHHALDACVLGIAANYFQNQKLGASSLWELLIKRKYNEQEKTILRALGIFQFDKEGNSQIKELPKEIREQIRQRLAEKRVVQHIP

SEQ ID NO: 2221 - protein, 154 aa, unidentified; identical to SEQ ID NO: 2146
  REGION 1..154: note = Description of Unknown:uncultivated organism with predicted taxonomy: Verrucomicrobiabacterium
  REGION 1..154: note = MG2-84 RuvC-III domain

SEQ ID NO: 2222 - protein, 154 aa, unidentified; identical to SEQ ID NO: 2214
  REGION 1..154: note = Description of Unknown:uncultivated organism with predicted taxonomy: Verrucomicrobiabacterium
  REGION 1..154: note = MG2-85 RuvC-III domain

SEQ ID NO: 2223 - protein, 154 aa, unidentified; identical to SEQ ID NO: 2146
  REGION 1..154: note = Description of Unknown:uncultivated organism
  REGION 1..154: note = MG2-86 RuvC-III domain

SEQ ID NO: 2224 - protein, 154 aa, unidentified; identical to SEQ ID NO: 2146
  REGION 1..154: note = Description of Unknown:uncultivated organism with predicted taxonomy: Methylococcalesbacterium
  REGION 1..154: note = MG2-87 RuvC-III domain

SEQ ID NO: 2225 - protein, 154 aa, unidentified; identical to SEQ ID NO: 2146
  REGION 1..154: note = Description of Unknown:uncultivated organism
  REGION 1..154: note = MG2-88 RuvC-III domain

SEQ ID NO: 2226 - protein, 154 aa, unidentified; identical to SEQ ID NO: 2146
  REGION 1..154: note = Description of Unknown:uncultivated organism with predicted taxonomy: Verrucomicrobia
  REGION 1..154: note = MG2-89 RuvC-III domain

SEQ ID NO: 2227 - protein, 72 aa, unidentified
  REGION 1..72: note = Description of Unknown:uncultivated organism with predicted taxonomy: Verrucomicrobiabacterium
  REGION 1..72: note = MG2-90 RuvC-III domain
TQTSQLVRLGAQVLKKNLPHLTTGDVTSLPGSVTGTVRKGWKLEACLGLANPQVFDGNGGAKTKTEIRDITH

SEQ ID NO: 2228 - protein, 157 aa, unidentified; identical to SEQ ID NO: 2220
  REGION 1..157: note = Description of Unknown:uncultivated organism
  REGION 1..157: note = MG2-91 RuvC-III domain

SEQ ID NO: 2229 - protein, 54 aa, unidentified
  REGION 1..54: note = Description of Unknown:uncultivated organism with predicted taxonomy:Verrucomicrobiae bacterium Tous-C5FEB
  REGION 1..54: note = MG2-92 RuvC-III domain
TVTSQLVRLGAQIIKKTFAENEKLPTVVSLPGSVTGTVRKGWNLLGCLATAAPQ

SEQ ID NO: 2230 - protein, 174 aa, unidentified
  REGION 1..174: note = Description of Unknown:uncultivated organism
  REGION 1..174: note = MG2-94 RuvC-III domain
TQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIP

SEQ ID NO: 2231 - protein, 174 aa, unidentified; identical to SEQ ID NO: 2230
  REGION 1..174: note = Description of Unknown:uncultivated organism
  REGION 1..174: note = MG2-95 RuvC-III domain

SEQ ID NO: 2232 - protein, 174 aa, unidentified; identical to SEQ ID NO: 2142
  REGION 1..174: note = Description of Unknown:uncultivated organism
  REGION 1..174: note = MG2-96 RuvC-III domain

SEQ ID NO: 2233 - protein, 173 aa, unidentified
  REGION 1..173: note = Description of Unknown:uncultivated organism with predicted taxonomy: Acidobacteriabacterium RIFCSPLOWO2_12_FULL_68_19
  REGION 1..173: note = MG2-97 RuvC-III domain
TQTSHLNKMAISLVKQRIGIDAKHLPGSVTAFIRQKLHIDECLFTAVPRLQKTAKGEGKRPKRKNADEVTAEPMQSDMPPRKLTKADIRELTHLHHAMDAVTQGLALLLFAPEDWPLLVKRNLTDSERRLLKSRYPYLVFTENSRMEIQDLPEATLKTISDRLAECRVIRHIP

SEQ ID NO: 2234 - protein, 154 aa, unidentified
  REGION 1..154: note = Description of Unknown:uncultivated organism with predicted taxonomy: Verrucomicrobiabacterium
  REGION 1..154: note = MG2-98 RuvC-III domain
TITSQLVRLGARTLEKAFTDGNHAPKIVSMPGSVTGRVQRAWSLMGCIAKANPSVLDENGKPKPKGDIRDISHLHHAVDACVLGIAGTLFPNDGSLWKAMAARSPARAEAEQLLATGLYERDSEKHLRLRDLPAALKNQIADRLSERRVYQHVS

SEQ ID NO: 2235 - protein, 174 aa, unidentified; identical to SEQ ID NO: 2142
  REGION 1..174: note = Description of Unknown:uncultivated organism
  REGION 1..174: note = MG2-99 RuvC-III domain

SEQ ID NO: 2236 - protein, 174 aa, unidentified; identical to SEQ ID NO: 2230
  REGION 1..174: note = Description of Unknown:uncultivated organism with predicted taxonomy: Proteobacteria
  REGION 1..174: note = MG2-100 RuvC-III domain

SEQ ID NO: 2237 - protein, 174 aa, unidentified
  REGION 1..174: note = Description of Unknown:uncultivated organism with predicted taxonomy: Bradyrhizobium
  REGION 1..174: note = MG2-101 RuvC-III domain
TQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSEKRLLKARYPFLLFNGDNNISIQDLPEAALQTISDRLAECRVVRHIP

SEQ ID NO: 2238 - protein, 154 aa, unidentified
  REGION 1..154: note = Description of Unknown:uncultivated organism with predicted taxonomy: Methylococcalesbacterium
  REGION 1..154: note = MG2-102 RuvC-III domain
TQTSQLVRLGAQVLKRVFANSEKKSPVVSLPGSVTGAVRKAWKVLGCLSLANQQVLDENGDVKTKTDIRDITHLHHALDACVLGLTSHFIPNNGRVWELIVKRNPNELEKRELMALGVFGFNAEKRFEMRDLDNKLKEQIRQRLAEKRVVQHIP

SEQ ID NO: 2239 - protein, 153 aa, unidentified
  REGION 1..153: note = Description of Unknown:uncultivated organism with predicted taxonomy: Verrucomicrobiabacterium
  REGION 1..153: note = MG2-103 RuvC-III domain
TQTSQLVRLGAQVLRNVLPHLKQNDVISLPGSVTGTVRKAWKVLGCLSLANPQVLDENGDVKTKTDIRDITHLHHALDACVLGLVSHFIPNSGQVWELIVKRNPNDTEKKQLTALGVFGFGKDNRFEMRDLDDRLKEQIRQRLAEKRVVQHVP

SEQ ID NO: 2240 - protein, 158 aa, unidentified
  REGION 1..158: note = Description of Unknown:uncultivated organism with predicted taxonomy: Verrucomicrobiabacterium
  REGION 1..158: note = MG2-104 RuvC-III domain
TVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVP

SEQ ID NO: 2241 - protein, 158 aa, unidentified; identical to SEQ ID NO: 2240
  REGION 1..158: note = Description of Unknown:uncultivated organism with predicted taxonomy: Verrucomicrobiabacterium
  REGION 1..158: note = MG2-105 RuvC-III domain

SEQ ID NO: 2242 - protein, 163 aa, unidentified
  REGION 1..163: note = Description of Unknown:uncultivated organism with predicted taxonomy: Rothia
  REGION 1..163: note = MG3-6 RuvC-III domain
ASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRP

SEQ ID NO: 2243 - protein, 159 aa, unidentified
  REGION 1..159: note = Description of Unknown:uncultivated organism with predicted taxonomy: Rothia
  REGION 1..159: note = MG3-7 RuvC-III domain
ASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRP

SEQ ID NO: 2244 - protein, 163 aa, unidentified
  REGION 1..163: note = Description of Unknown:uncultivated organism with predicted taxonomy: Rothia
  REGION 1..163: note = MG3-8 RuvC-III domain
ASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRP

SEQ ID NO: 2245 - protein, 145 aa, unidentified
  REGION 1..145: note = Description of Unknown:uncultivated organism with predicted taxonomy: Dermabacterhominis
  REGION 1..145: note = MG3-1 RuvC-III domain
ASTSYAATEITRRILGHFHDEVPVVAFGGSGTREARRAGRVDHIIRLRGSLDKSRLDTRHHAIDAAVLTLQSPAIYRVLLTRVNLKHEHEVTGEAPEWRDYEGADQAEKVLYRRWQKNIATLAELMRQEIENNRVPVTRPIRLRK

SEQ ID NO: 2246 - protein, 148 aa, unidentified
  REGION 1..148: note = Description of Unknown:uncultivated organism with predicted taxonomy: Micrococcales
  REGION 1..148: note = MG3-5 RuvC-III domain
SATAFAAVEIRRKLENHFKDRTKPVRVDVYRGALTRESRRAGRIDAKIRLRGNIDKDRLDIRHHAIDAAVLTLLDPSVAKTLAMRLDLKREQQDSGRDTRWKEFKGLTPASQERFIKWCQASECLADMLRQQIEADRVPVVVPLRISP

SEQ ID NO: 2247 - protein, 156 aa, unidentified
  REGION 1..156: note = Description of Unknown:uncultivated organism with predicted taxonomy: Rothia
  REGION 1..156: note = MG3-6 RuvC-III domain
ASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRP

SEQ ID NO: 2248 - protein, 163 aa, unidentified
  REGION 1..163: note = Description of Unknown:uncultivated organism with predicted taxonomy: Rothia
  REGION 1..163: note = MG3-7 RuvC-III domain
ASTSYAAVAVRERLEQHFNEGLAPDDKSRVVLDVYAGAVTRESRRAGGIDERILLRGERDKNRFDVRHHAIDAAVMTLLNRSVALTLEQRSQLRRAFYELELDKLDRDQLKPGEDWRNFTGLYEASQNKFSEWKKAATVLGDLLAEAIEDDAIAVVSPLRLRP

SEQ ID NO: 2249 - protein, 163 aa, unidentified; identical to SEQ ID NO: 2244
  REGION 1..163: note = Description of Unknown:uncultivated organism with predicted taxonomy: Rothia
  REGION 1..163: note = MG3-8 RuvC-III domain

SEQ ID NO: 2250 - protein, 152 aa, unidentified
  REGION 1..152: note = Description of Unknown:uncultivated organism with predicted taxonomy: Brevibacterium
  REGION 1..152: note = MG3-42 RuvC-III domain
ESTAYAATEIRRRLQYYFEENCGANSPQPEILVLPGAVTREARRAGGFDSRIKLRGKNDKDRFDARHHALDAAIMTVVDRSVARTLQQRSDLKYSNFLTGAEPRWKDFKGDSPESRKKFERWVQTSNRLADLVSDAIVTDSIPVIFPLRLGT

SEQ ID NO: 2251 - protein, 144 aa, unidentified
  REGION 1..144: note = Description of Unknown:uncultivated organism with predicted taxonomy: Brevibacteriummcbrellneri
  REGION 1..144: note = MG3-68 RuvC-III domain
ESTAYAATEIRRRVQYYFEENCGANVPQPEIFVLPGAVTREARRAGGFDSRIKLRGKGDKDRFDARHHALDAAIMTVVDWSVARTLQQRSDLKYSNFLTGAEPRWKEFKGDSPEARKKFERWIQTSNRLADLVSDAIVAAAIPV

SEQ ID NO: 2252 - protein, 152 aa, unidentified; identical to SEQ ID NO: 2250
  REGION 1..152: note = Description of Unknown:uncultivated organism with predicted taxonomy: Brevibacteriummcbrellneri
  REGION 1..152: note = MG3-88 RuvC-III domain

SEQ ID NO: 2253 - protein, 131 aa, unidentified
  REGION 1..131: note = Description of Unknown:uncultivated organism with predicted taxonomy: Planctomycetes
  REGION 1..131: note = MG4-5 RuvC-III domain
NDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRK

SEQ ID NO: 2254 - protein, 121 aa, unidentified
  REGION 1..121: note = Description of Unknown:uncultivated organism
  REGION 1..121: note = MG4-11 RuvC-III domain
TDTSYISKKAVEYVSLLFGGSIDAKGKRRVFATKGGITGRLRREWGLNVLLGGEDEKNRADHRHHAIDALVIALSTPAVIKKIGGEDTRPKEDILPPIDNLADVAREVLEKVNVVYRCSQK

SEQ ID NO: 2255 - protein, 148 aa, unidentified
  REGION 1..148: note = Description of Unknown:uncultivated organism
  REGION 1..148: note = MG4-12 RuvC-III domain
NDSRYMSKLALRYLGVLYGAVNGCVGGQDEDEGGKRVIFASTGKVTAWIRREWRLNEILCDDDEPTGEGADVEKNRNDHRHHAIDALVISLSTPSYVQQLNRAAQLADNDAKARLFKKGNFMPPVTGFKALVAQVVDGIVVSKRVDSK

SEQ ID NO: 2256 - protein, 134 aa, unidentified
  REGION 1..134: note = Description of Unknown:uncultivated organism
  REGION 1..134: note = MG4-13 RuvC-III domain
NDTKYASKLAKKFLGLLYPGQEALSRVQATKGGITANLRDVFNLNSILKDGDSVERDGYEPKKTRADHRHHAIDAICIALTEPSTVKMLSEASSRALKERKRRFGKVQPPWENFWEDVKKAIDNTIVSHRVSKK

SEQ ID NO: 2257 - protein, 130 aa, unidentified
  REGION 1..130: note = Description of Unknown:uncultivated organism
  REGION 1..130: note = MG4-14 RuvC-III domain
NDTAHASRSALRYLGLLYGSNKAGVGPDGRRRVQAGRGQVTAFLRDEWRLNSILGDLQKSRADHRHHAVDALAIALTDSRIIKTLSDAASRALSERRRRFGRVAPPWKSFLEEAKNAIAATIVSHRVSRK

SEQ ID NO: 2258 - protein, 128 aa, unidentified
  REGION 1..128: note = Description of Unknown:uncultivated organism with predicted taxonomy: Thermoguttaterrifontis
  REGION 1..128: note = MG4-15 RuvC-III domain
SDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRR

SEQ ID NO: 2259 - protein, 128 aa, unidentified; identical to SEQ ID NO: 2258
  REGION 1..128: note = Description of Unknown:uncultivated organism with predicted taxonomy: Thermoguttaterrifontis
  REGION 1..128: note = MG4-16 RuvC-III domain

SEQ ID NO: 2260 - protein, 128 aa, unidentified
  REGION 1..128: note = Description of Unknown:uncultivated organism with predicted taxonomy: Thermoguttaterrifontis
  REGION 1..128: note = MG4-17 RuvC-III domain
NDTRWISKAAADYFGYLYGGRIAPTGQQRVFTVTGGLTALFRRAWNLNAVLGGNPEKNRYDHRHHAIDAIVVALTEPSMIQRFSNEAEKLIKAFPRVAVRLDPPWDTFLSDVQQHVERIVVSFRVNRR

SEQ ID NO: 2261 - protein, 128 aa, unidentified
  REGION 1..128: note = Description of Unknown:uncultivated organism with predicted taxonomy: Thermoguttaterrifontis
  REGION 1..128: note = MG4-18 RuvC-III domain
SDTRWISKAAADYLGHLYGGRIDPTGQQRVFTVAGGLTGLFRRAWNLNAILGGSPEKNRYDHRHHAIDAIVVALTEPSMIQRFAHEASRLLKAWPRVAVRLDPPWSTFLSDVQRHVEGIVVSFRVSRR

SEQ ID NO: 2262 - protein, 141 aa, unidentified
  REGION 1..141: note = Description of Unknown:uncultivated organism
  REGION 1..141: note = MG4-19 RuvC-III domain
NDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHR

SEQ ID NO: 2263 - protein, 141 aa, unidentified; identical to SEQ ID NO: 2262
  REGION 1..141: note = Description of Unknown:uncultivated organism
  REGION 1..141: note = MG4-20 RuvC-III domain

SEQ ID NO: 2264 - protein, 141 aa, unidentified; identical to SEQ ID NO: 2262
  REGION 1..141: note = Description of Unknown:uncultivated organism
  REGION 1..141: note = MG4-21 RuvC-III domain

SEQ ID NO: 2265 - protein, 141 aa, unidentified
  REGION 1..141: note = Description of Unknown:uncultivated organism with predicted taxonomy: Planctomycessp. SH-PL14
  REGION 1..141: note = MG4-22 RuvC-III domain
NDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGIVDSIRPHFEQMLVSHRPEHR

SEQ ID NO: 2266 - protein, 141 aa, unidentified; identical to SEQ ID NO: 2262
  REGION 1..141: note = Description of Unknown:uncultivated organism
  REGION 1..141: note = MG4-23 RuvC-III domain

SEQ ID NO: 2267 - protein, 141 aa, unidentified; identical to SEQ ID NO: 2262
  REGION 1..141: note = Description of Unknown:uncultivated organism
  REGION 1..141: note = MG4-24 RuvC-III domain

SEQ ID NO: 2268 - protein, 141 aa, unidentified; identical to SEQ ID NO: 2262
  REGION 1..141: note = Description of Unknown:uncultivated organism
  REGION 1..141: note = MG4-25 RuvC-III domain

SEQ ID NO: 2269 - protein, 141 aa, unidentified; identical to SEQ ID NO: 2262
  REGION 1..141: note = Description of Unknown:uncultivated organism
  REGION 1..141: note = MG4-26 RuvC-III domain

SEQ ID NO: 2270 - protein, 141 aa, unidentified; identical to SEQ ID NO: 2262
  REGION 1..141: note = Description of Unknown:uncultivated organism
  REGION 1..141: note = MG4-27 RuvC-III domain

SEQ ID NO: 2271 - protein, 141 aa, unidentified; identical to SEQ ID NO: 2262
  REGION 1..141: note = Description of Unknown:uncultivated organism
  REGION 1..141: note = MG4-28 RuvC-III domain

SEQ ID NO: 2272 - protein, 141 aa, unidentified; identical to SEQ ID NO: 2262
  REGION 1..141: note = Description of Unknown:uncultivated organism
  REGION 1..141: note = MG4-29 RuvC-III domain

SEQ ID NO: 2273 - protein, 134 aa, unidentified
  REGION 1..134: note = Description of Unknown:uncultivated organism with predicted taxonomy:Alphaproteobacteria bacterium
  REGION 1..134: note = MG4-30 RuvC-III domain
NDTAYASRLAADYLGILYGGRTDREHRLRVQATAGQATARLRARWNLDSILDDGPTKHGGRASKERTDHRHHAIDAVVIGVTDQGMMERLSDAAKRGQEVGKRFARLDEPWNGFLEQVRKEVGQIVVSHRVSKK

SEQ ID NO: 2274 - protein, 131 aa, unidentified
  REGION 1..131: note = Description of Unknown:uncultivated organism
  REGION 1..131: note = MG4-31 RuvC-III domain
NDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQAKVAVDKIVVSYRPDRK

SEQ ID NO: 2275 - protein, 133 aa, unidentified
  REGION 1..133: note = Description of Unknown:uncultivated organism
  REGION 1..133: note = MG4-32 RuvC-III domain
QETRYIGRLACDYLGLLYGGQVEAQGTAVSERRILTPTGGLVAWLRRGWGLNSVLSDRDEKERNDHRHHAVDAIVIACADQRAIQRLSESAERMEREGRERPYESVDPPWEGFEQSVQEAIHAVVVSHRQSRK

SEQ ID NO: 2276 - protein, 115 aa, unidentified
  REGION 1..115: note = Description of Unknown:uncultivated organism with predicted taxonomy:Insolitispirillum peregrinum
  REGION 1..115: note = MG4-33 RuvC-III domain
NDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQA

SEQ ID NO: 2277 - protein, 129 aa, unidentified
  REGION 1..129: note = Description of Unknown:uncultivated organism with predicted taxonomy: Planctomycetesbacterium
  REGION 1..129: note = MG4-34 RuvC-III domain
NDTRYMSRVACEYLGALYGGLSDEYHRRRVQSTTGGLTFELRRGWSLNSILGIGDEKNRADHRHHAVDAIVVALTGPKAIQQASRAAQRAETRGGARLFEEFEDPWPGFRDDVKAIVKSIVVSHRQSRK

SEQ ID NO: 2278 - protein, 133 aa, unidentified; identical to SEQ ID NO: 2275
  REGION 1..133: note = Description of Unknown:uncultivated organism
  REGION 1..133: note = MG4-35 RuvC-III domain

SEQ ID NO: 2279 - protein, 143 aa, unidentified
  REGION 1..143: note = Description of Unknown:uncultivated organism with predicted taxonomy: Proteobacteria
  REGION 1..143: note = MG4-36 RuvC-III domain
NDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHR

SEQ ID NO: 2280 - protein, 76 aa, unidentified
  REGION 1..76: note = Description of Unknown:uncultivated organism with predicted taxonomy: Solemyavelesiana gill symbiont
  REGION 1..76: note = MG4-37 RuvC-III domain
NDTRASAVAAARYLSLLYGGETVDGKRKILKVTGQVTAYLRDVWGLNGLIPSIHREARGEAEDGQAEARPVKSRDD

SEQ ID NO: 2281 - protein, 127 aa, unidentified
  REGION 1..127: note = Description of Unknown:uncultivated organism with predicted taxonomy: Acidobacteria
  REGION 1..127: note = MG4-38 RuvC-III domain
NDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHR

SEQ ID NO: 2282 - protein, 89 aa, unidentified
  REGION 1..89: note = Description of Unknown:uncultivated organism with predicted taxonomy: Planctomycetes
  REGION 1..89: note = MG4-39 RuvC-III domain
NDTRYSSRLASEYLSLLYGGRSDAQGNLRVQASTGAVTSLLRDQWGLNAILAELGRQLGVSGLDDDVEKARFDHRHHAVDALVIALTTP

SEQ ID NO: 2283 - protein, 127 aa, unidentified
  REGION 1..127: note = Description of Unknown:uncultivated organism with predicted taxonomy: Thermoguttaterrifontis
  REGION 1..127: note = MG4-40 RuvC-III domain
SDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRR

SEQ ID NO: 2284 - protein, 116 aa, unidentified
  REGION 1..116: note = Description of Unknown:uncultivated organism with predicted taxonomy: Planctomycetes
  REGION 1..116: note = MG4-41 RuvC-III domain
NDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPP

SEQ ID NO: 2285 - protein, 127 aa, unidentified; identical to SEQ ID NO: 2283
  REGION 1..127: note = Description of Unknown:uncultivated organism with predicted taxonomy: Thermoguttaterrifontis
  REGION 1..127: note = MG4-42 RuvC-III domain

SEQ ID NO: 2286 - protein, 127 aa, unidentified; identical to SEQ ID NO: 2283
  REGION 1..127: note = Description of Unknown:uncultivated organism
  REGION 1..127: note = MG4-43 RuvC-III domain

SEQ ID NO: 2287 - protein, 132 aa, unidentified
  REGION 1..132: note = Description of Unknown:uncultivated organism with predicted taxonomy: Proteobacteria
  REGION 1..132: note = MG4-44 RuvC-III domain
NDTRHAAKVAMGYLGLLYPKEERLKRVKAFAGGVTGELRKCWKLNSILGDPDSVEPKKNRADHRHHAIDALVLALATPGMVQYLSKAAAQQLACQRSIRGYQKFMEDPWPHFLEDVRKAVNAIVVSHRVDHR

SEQ ID NO: 2288 - protein, 132 aa, unidentified; identical to SEQ ID NO: 2287
  REGION 1..132: note = Description of Unknown:uncultivated organism
  REGION 1..132: note = MG4-45 RuvC-III domain

SEQ ID NO: 2289 - protein, 127 aa, unidentified; identical to SEQ ID NO: 2283
  REGION 1..127: note = Description of Unknown:uncultivated organism
  REGION 1..127: note = MG4-46 RuvC-III domain

SEQ ID NO: 2290 - protein, 143 aa, unidentified
  REGION 1..143: note = Description of Unknown:uncultivated organism with predicted taxonomy: Proteobacteria
  REGION 1..143: note = MG4-47 RuvC-III domain
NDTRASAVAAARYLSLLYGGETVDGKRKILKVTGQVTAYLRDVWGLNGLIPSIHREARGEAEDRQAEARPVKSRDDHRHHAVDAVVVALCNQGWIQRLSEANRGALAARRRLFAPVEPPWVGFKEQLKDILKSMNISFRPDHR

SEQ ID NO: 2291 - protein, 122 aa, unidentified
  REGION 1..122: note = Description of Unknown:uncultivated organism
  REGION 1..122: note = MG4-48 RuvC-III domain
HATAYAARVAARELARLYPNQERAHRIWVSSGRATACLRDAWQLNQLLGRKDEKNRADHRHHMVDAVVVALTTPKIVQDLTHAAQNAVRARRFQGMEPPSGLHEALRQRLEKVIVSHRVERK

SEQ ID NO: 2292 - protein, 143 aa, unidentified
  REGION 1..143: note = Description of Unknown:uncultivated organism
  REGION 1..143: note = MG4-49 RuvC-III domain
NDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPPWGTRAQFVADVRNAVLAINVSRRVDRR

SEQ ID NO: 2293 - protein, 92 aa, unidentified
  REGION 1..92: note = Description of Unknown:uncultivated organism with predicted taxonomy: Solemyavelesiana gill symbiont
  REGION 1..92: note = MG4-51 RuvC-III domain
NDTRAAAVAAARYLALLFGGETVGGKLKILKITGQVTAHLRDAWDLNGLIPSIHRETRGEAADKEPKTPPLKSRDDHRHHAVDAVVVALCDQ

SEQ ID NO: 2294 - protein, 143 aa, unidentified
  REGION 1..143: note = Description of Unknown:uncultivated organism
  REGION 1..143: note = MG4-52 RuvC-III domain
NDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHR

SEQ ID NO: 2295 - protein, 128 aa, unidentified
  REGION 1..128: note = Description of Unknown:uncultivated organism
  REGION 1..128: note = MG4-53 RuvC-III domain
NDTRYAARAAAEYLGRLYGGQSDAGHRRRIQVATGQVTAFLRREWGLNAILGDGDEKSRDDHRHHAVDALCVALTDAGIVQALAAAAARAPAEGRRCFARLAPPWPSFLADARRAVLEITVSHRVRRK

SEQ ID NO: 2296 - protein, 127 aa, unidentified; identical to SEQ ID NO: 2281
  REGION 1..127: note = Description of Unknown:uncultivated organism
  REGION 1..127: note = MG4-54 RuvC-III domain

SEQ ID NO: 2297 - protein, 132 aa, unidentified
  REGION 1..132: note = Description of Unknown:uncultivated organism with predicted taxonomy: Flavobacteriumhercynium
  REGION 1..132: note = MG4-55 RuvC-III domain
NDTRHAAKVAMGYLGLLYPKEERLKRVKAFAGGVTGELRKCWKLNSILGDPDSVEPKKNRADHRHHAIDALVLALATPGMVQYLSKAAEQQLACQRSIRGYQKFMEDPWPHFLEDVRKAVNAIVVSHRVDHR

SEQ ID NO: 2298 - protein, 143 aa, unidentified; identical to SEQ ID NO: 2279
  REGION 1..143: note = Description of Unknown:uncultivated organism with predicted taxonomy:Pseudoxanthobacter soli
  REGION 1..143: note = MG4-56 RuvC-III domain

SEQ ID NO: 2299 - protein, 128 aa, unidentified
  REGION 1..128: note = Description of Unknown:uncultivated organism with predicted taxonomy: candidatedivision Zixibacteria bacterium CG_4_9_14_3_um_filter_46_8
  REGION 1..128: note = MG4-57 RuvC-III domain
NDTRYASVLAAKYLGALYGGAIDAEHTRRIQVSAGMVTAYLRNEYGLNPILGDGGEKSRDDHRHHAIDAICVALTDAATVKMLSDAASRALSERRRQFGHIDPPWPSFLADVRKHIDDLIVSHAVSRK

SEQ ID NO: 2300 - protein, 143 aa, unidentified; identical to SEQ ID NO: 2294
  REGION 1..143: note = Description of Unknown:uncultivated organism
  REGION 1..143: note = MG4-58 RuvC-III domain

SEQ ID NO: 2301 - protein, 143 aa, unidentified; identical to SEQ ID NO: 2294
  REGION 1..143: note = Description of Unknown:uncultivated organism with predicted taxonomy: Proteobacteria
  REGION 1..143: note = MG4-60 RuvC-III domain

SEQ ID NO: 2302 - protein, 127 aa, unidentified; identical to SEQ ID NO: 2283
  REGION 1..127: note = Description of Unknown:uncultivated organism with predicted taxonomy: Thermoguttaterrifontis
  REGION 1..127: note = MG4-61 RuvC-III domain

SEQ ID NO: 2303 - protein, 124 aa, unidentified
  REGION 1..124: note = Description of Unknown:uncultivated organism
  REGION 1..124: note = MG4-62 RuvC-III domain
QDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQR

SEQ ID NO: 2304 - protein, 132 aa, unidentified
  REGION 1..132: note = Description of Unknown:uncultivated organism with predicted taxonomy: Planctomycessp. SH-PL14
  REGION 1..132: note = MG4-63 RuvC-III domain
SETRYIARQAADYLGLLYGGRIEQRAGDEVGRRRVLVTPGRATALLRNGWQLASVTGGLKNRQDHRHHAIDALIVGLTQDGFLKQLSEAAARADELQLTRLTTEMDSPWETFLDDVGKGYERIHVSTRPTRK

SEQ ID NO: 2305 - protein, 124 aa, unidentified; identical to SEQ ID NO: 2303
  REGION 1..124: note = Description of Unknown:uncultivated organism
  REGION 1..124: note = MG4-64 RuvC-III domain

SEQ ID NO: 2306 - protein, 128 aa, unidentified
  REGION 1..128: note = Description of Unknown:uncultivated organism
  REGION 1..128: note = MG4-65 RuvC-III domain
QDTRYACRLAADYLGRLYGGRVDAQGKMRIEVRPGGLTAHVRNELMLHAILDDGGAKTRADHRHHAVDALAVGLTSQSMVQQLQTAAGRALQAGRRLFAPVPEPWTGFLEDARRSIGQIIVSRRPDRK

SEQ ID NO: 2307 - protein, 143 aa, unidentified
  REGION 1..143: note = Description of Unknown:uncultivated organism
  REGION 1..143: note = MG4-66 RuvC-III domain
NDTRYSSRLAAEYLALLYGGRSDAQGNLRVRAITGAVTAQLRDQWGLNAVLAELGRQLGVRDLDDNVEKARFDHRHHAVDALVIALTTPGMVKRFSDESQRARQYGRQLRCFFDPPWGTRTEFVADVRNAVLAINVSRRLDRR

SEQ ID NO: 2308 - protein, 128 aa, unidentified
  REGION 1..128: note = Description of Unknown:uncultivated organism with predicted taxonomy: Proteobacteria
  REGION 1..128: note = MG4-67 RuvC-III domain
NDTRYASRLAAEYVGLLYGGRADAEHRQRVYVCTGGTTAFLRNEWKLNTILGDGGPKTRDDHRHHAVDALVIALTGPATVKMLADAADNPWQHRRRLFAPIQEPWVGFLDQAREAILRINVSHRVNRR

SEQ ID NO: 2309 - protein, 127 aa, unidentified
  REGION 1..127: note = Description of Unknown:uncultivated organism with predicted taxonomy: Thermoguttaterrifontis
  REGION 1..127: note = MG4-68 RuvC-III domain
SDTRWITTAAADYLGYLYGGRIDSEGRQRVFTVTGPLTALIRRGWNLDGILGGPEKNRFDYRQHAIDAIVIALIDQAIVQQISLLSSRLWGTDRPTAVQLPEPWPSFYHDAKNAILNIVVSHRISRR

SEQ ID NO: 2310 - protein, 143 aa, unidentified
  REGION 1..143: note = Description of Unknown:uncultivated organism with predicted taxonomy: Planctomycetesbacterium
  REGION 1..143: note = MG4-70 RuvC-III domain
NDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHR

SEQ ID NO: 2311 - protein, 140 aa, unidentified
  REGION 1..140: note = Description of Unknown:uncultivated organism
  REGION 1..140: note = MG4-71 RuvC-III domain
TDTRYASRLAADYLGLLYGGTVDAAGRRRVQTSSGTATWYLRSEWDMNAVIPGLSGSPTGSASGTFIEKVRTDHRHHAIDAVAIALTSARVVKMLADAARNPEQHRRRRFAPVPPPWPNFKDEVSAAAEKIIVSHRVDRR

SEQ ID NO: 2312 - protein, 135 aa, unidentified
  REGION 1..135: note = Description of Unknown:uncultivated organism with predicted taxonomy: Acidobacteria
  REGION 1..135: note = MG4-72 RuvC-III domain
NDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPWPNFVDSVRTEIDRIIVSHRVSKK

SEQ ID NO: 2313 - protein, 85 aa, unidentified
  REGION 1..85: note = Description of Unknown:uncultivated organism
  REGION 1..85: note = MG4-73 RuvC-III domain
TDTRYASRLAADYLGLLYGGTVDAAGRRRVQTSSGTATWYLRSEWDMNAVIPGLSGSPTGSASGTFIEKVRTDHRHHAIDAVAIA

SEQ ID NO: 2314 - protein, 135 aa, unidentified
  REGION 1..135: note = Description of Unknown:uncultivated organism with predicted taxonomy: Acidobacteria
  REGION 1..135: note = MG4-74 RuvC-III domain
NDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPCPNFVDSVRTEIDRIIVSHRVSKK

SEQ ID NO: 2315 - protein, 143 aa, unidentified; identical to SEQ ID NO: 2310
  REGION 1..143: note = Description of Unknown:uncultivated organism with predicted taxonomy: Proteobacteria
  REGION 1..143: note = MG4-76 RuvC-III domain

SEQ ID NO: 2316 - protein, 142 aa, unidentified
  REGION 1..142: note = Description of Unknown:uncultivated organism
  REGION 1..142: note = MG4-77 RuvC-III domain
NDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELRQVLRSMNISFRPDHR

SEQ ID NO: 2317 - protein, 122 aa, unidentified
  REGION 1..122: note = Description of Unknown:uncultivated organism
  REGION 1..122: note = MG4-78 RuvC-III domain
QATAHAARLAGRLLGRWYPAEERLSRIQITNGAVTSWLRVAWGLNQLLGVADEKNRSDHRHHLVDATVIALTTAATVKALTEAARRSARPRRFVDMPVPPGLVDSLRQQLETVIVSHRVDRR

SEQ ID NO: 2318 - protein, 122 aa, unidentified; identical to SEQ ID NO: 2317
  REGION 1..122: note = Description of Unknown:uncultivated organism
  REGION 1..122: note = MG4-79 RuvC-III domain

SEQ ID NO: 2319 - protein, 132 aa, unidentified
  REGION 1..132: note = Description of Unknown:uncultivated organism with predicted taxonomy: Planctomycetes
  REGION 1..132: note = MG4-80 RuvC-III domain
NDTRHSTKLAAQYLGLLYGGPYDAQGHRRLVAVSGSITAHLRRAWRLGVHPGPDQAGPGKNRDDHRHHALDAIVVALTSHATIQKLSTFAARSQPGQQRLITGDLQEPWPSFQRDVRQALMAIYVSFRAEHK

SEQ ID NO: 2320 - protein, 127 aa, unidentified
  REGION 1..127: note = Description of Unknown:uncultivated organism with predicted taxonomy:Rhodobacteraceae
  REGION 1..127: note = MG4-81 RuvC-III domain
NDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELR

SEQ ID NO: 2321 - protein, 135 aa, unidentified
  REGION 1..135: note = Description of Unknown:uncultivated organism
  REGION 1..135: note = MG4-82 RuvC-III domain
VDTRYMSRAAAEYVGLLYGGAVDSQGTRRVQVSPGGVTADLRRLWGLNRVLPRDPGDDERPGKKSRSDHRHHALDAAVIALTSPAMVQQLSRCAQDALLIGSRRFVALELPFPSLIDDLKKAIDEIVVSYRVKRK

SEQ ID NO: 2322 - protein, 133 aa, unidentified
  REGION 1..133: note = Description of Unknown:uncultivated organism
  REGION 1..133: note = MG4-83 RuvC-III domain
NDTRYISRLAVQYAGLLYGAGADGVDPSGRRRVQAARGQITAHLRDVYELNSLLGDGGEKYRGDHRHHAVDALCVALTTPRAVKQLSDAAAAGEDRRRAWYDTRLITDPWPGFLDDARNAVNAIVVSHCPSRK

SEQ ID NO: 2323 - protein, 126 aa, unidentified
  REGION 1..126: note = Description of Unknown:uncultivated organism
  REGION 1..126: note = MG4-84 RuvC-III domain
NDTRYAAVEAMDFLKLLYGEEAQRKVIVQAARGGTTRFLREEFGLNQILGDGGEKSRDDHRHHAVDAICVALTDPATVKMLSDAAARALSEGRRRFASVPFPWGRFLDDVRASIQGINVSFRVSRK

SEQ ID NO: 2324 - protein, 122 aa, unidentified; identical to SEQ ID NO: 2317
  REGION 1..122: note = Description of Unknown:uncultivated organism
  REGION 1..122: note = MG4-85 RuvC-III domain

SEQ ID NO: 2325 - protein, 122 aa, unidentified; identical to SEQ ID NO: 2317
  REGION 1..122: note = Description of Unknown:uncultivated organism
  REGION 1..122: note = MG4-86 RuvC-III domain

SEQ ID NO: 2326 - protein, 134 aa, unidentified
  REGION 1..134: note = Description of Unknown:uncultivated organism
  REGION 1..134: note = MG4-87 RuvC-III domain
SDTRYIARAVSEYLGVLYGGRTDADGKQRIVACSGGLTSWLRREWGLDALLSPTGDDAEAEKNRIDHRHHAVDALVVALTTPRTQAMLQAAAARQEQEGRFRLFGRIEPLWSAFPREAKAAVEAIVVSHRQQRA

SEQ ID NO: 2327 - protein, 121 aa, unidentified
  REGION 1..121: note = Description of Unknown:uncultivated organism with predicted taxonomy: Planctomycetesbacterium
  REGION 1..121: note = MG4-88 RuvC-III domain
NDTRHNSKVAAEYLGLLYGGLWDASGKRRIEAITGGITALLRNAWRLRKDRADHRHHALDAIVLALVDPAQVKSLQESAERASEGSARFRLGELDEPWPGFRDAVRSALEEINVSIRADRK

SEQ ID NO: 2328 - protein, 61 aa, unidentified
  REGION 1..61: note = Description of Unknown:uncultivated organism with predicted taxonomy:Planctomicrobium piriforme
  REGION 1..61: note = MG4-89 RuvC-III domain
AETRKIGAASAGFLGLLYGGEIDAAHKRRVFVTTGGLTAHLRREWHLNGILGTEGEKARDD

SEQ ID NO: 2329 - protein, 124 aa, unidentified; identical to SEQ ID NO: 2303
  REGION 1..124: note = Description of Unknown:uncultivated organism
  REGION 1..124: note = MG4-90 RuvC-III domain

SEQ ID NO: 2330 - protein, 130 aa, unidentified
  REGION 1..130: note = Description of Unknown:uncultivated organism with predicted taxonomy:Deltaproteobacteria bacterium
  REGION 1..130: note = MG4-91 RuvC-III domain
RETSYFARLAQEYVGLLYGGIVDAEGTRRVIASSGGATHWLRRELGLDSILSDDEEKNRSDHRHHAVDAITTALLDSRTIQLLARAAQEAEERGSRRLFLSLQEEPWQGCRRDVEEAVARINVSHRQRRR

SEQ ID NO: 2331 - protein, 127 aa, unidentified
  REGION 1..127: note = Description of Unknown:uncultivated organism with predicted taxonomy:Alphaproteobacteria
  REGION 1..127: note = MG4-92 RuvC-III domain
TDTAYAARLARDYLGVLYGAESLRRIQVLPGRLTSLLRGAWQLNRILGDPERNTKSRADHRHHAIDALVAAVTDRSMVQKICTRAKQLEDLKQVRLLPEIDPPWAGLLNDTREALARTIPSSRVDRK

SEQ ID NO: 2332 - protein, 127 aa, unidentified
  REGION 1..127: note = Description of Unknown:uncultivated organism with predicted taxonomy: Proteobacteria
  REGION 1..127: note = MG4-93 RuvC-III domain
TDTAYAARLARDYLGVLYGAESLRRIQVLPGRLTSLLRGAWQLNRILGDPERNTKSRADHRHHAIDALVAAVTDRSMVQKICTRAKQLEELKQARLLPEIDPPWAGLLNDTREALARTIPSSRADRK

SEQ ID NO: 2333 - protein, 130 aa, unidentified
  REGION 1..130: note = Description of Unknown:uncultivated organism with predicted taxonomy:Planctomycetales bacterium 4484_113
  REGION 1..130: note = MG4-94 RuvC-III domain
NDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRR

SEQ ID NO: 2334 - protein, 126 aa, unidentified
  REGION 1..126: note = Description of Unknown:uncultivated organism with predicted taxonomy: Planctomycetesbacterium
  REGION 1..126: note = MG4-95 RuvC-III domain
NDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRR

SEQ ID NO: 2335 - protein, 130 aa, unidentified; identical to SEQ ID NO: 2333
  REGION 1..130: note = Description of Unknown:uncultivated organism with predicted taxonomy:Planctomycetales bacterium 4484_113
  REGION 1..130: note = MG4-96 RuvC-III domain

SEQ ID NO: 2336 - protein, 122 aa, unidentified
  REGION 1..122: note = Description of Unknown:uncultivated organism with predicted taxonomy: Planctomycetesbacterium
  REGION 1..122: note = MG4-97 RuvC-III domain
NATAYAARYAARHLALLYPQEERRKRVQVSAGRTTAYLRRAWNLNRLIGLADEKNRADYRHHAVDAVVIALTTPKLTGELSKAAARSVRPGTFQGLTPPPGLTRQLEEILDQMVVSHRVDRR

SEQ ID NO: 2337 - protein, 132 aa, unidentified
  REGION 1..132: note = Description of Unknown:uncultivated organism
  REGION 1..132: note = MG4-98 RuvC-III domain
NDTAWASKWAKKYLGLLYGDIKSKGIDSAGKLRVQAVSGRLTSELRRIWGLNNILGDGNTKSRDDHRHHAIDAIVIALSNPAVVKQLAEASKRAVNIGDKLLKDFPQPWEGFHNDVKRVIDGIIASHRVSKR

SEQ ID NO: 2338 - protein, 126 aa, unidentified; identical to SEQ ID NO: 2334
  REGION 1..126: note = Description of Unknown:uncultivated organism with predicted taxonomy: Planctomycetesbacterium
  REGION 1..126: note = MG4-99 RuvC-III domain

SEQ ID NO: 2339 - protein, 126 aa, unidentified; identical to SEQ ID NO: 2334
  REGION 1..126: note = Description of Unknown:uncultivated organism with predicted taxonomy: Planctomycetesbacterium
  REGION 1..126: note = MG4-100 RuvC-III domain

SEQ ID NO: 2340 - protein, 132 aa, unidentified; identical to SEQ ID NO: 2337
  REGION 1..132: note = Description of Unknown:uncultivated organism
  REGION 1..132: note = MG4-101 RuvC-III domain

SEQ ID NO: 2341 - protein, 134 aa, unidentified
  REGION 1..134: note = Description of Unknown:uncultivated organism
  REGION 1..134: note = MG4-102 RuvC-III domain
NDTRYAAKEAAAYLGMLYGGSVTSIDGRKRVQVLSGGLTYKVRSAYNLNGILNDGDVKTRNDHRHHAVDAIAIGMTSPGMVKKLTEIAKELENRRDYIRFGTGKGILPDKWNTFDEDVRRVIGKIKVSHKIPRK

SEQ ID NO: 2342 - protein, 134 aa, unidentified; identical to SEQ ID NO: 2341
  REGION 1..134: note = Description of Unknown:uncultivated organism
  REGION 1..134: note = MG4-103 RuvC-III domain

SEQ ID NO: 2343 - protein, 125 aa, unidentified
  REGION 1..125: note = Description of Unknown:uncultivated organism with predicted taxonomy: Planctomycetesbacterium
  REGION 1..125: note = MG4-104 RuvC-III domain
NDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINR

SEQ ID NO: 2344 - protein, 125 aa, unidentified; identical to SEQ ID NO: 2343
  REGION 1..125: note = Description of Unknown:uncultivated organism
  REGION 1..125: note = MG4-105 RuvC-III domain

SEQ ID NO: 2345 - protein, 125 aa, unidentified
  REGION 1..125: note = Description of Unknown:uncultivated organism
  REGION 1..125: note = MG4-106 RuvC-III domain
NDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNK

SEQ ID NO: 2346 - protein, 125 aa, unidentified; identical to SEQ ID NO: 2345
  REGION 1..125: note = Description of Unknown:uncultivated organism
  REGION 1..125: note = MG4-107 RuvC-III domain

SEQ ID NO: 2347 - protein, 125 aa, unidentified; identical to SEQ ID NO: 2343
  REGION 1..125: note = Description of Unknown:uncultivated organism
  REGION 1..125: note = MG4-108 RuvC-III domain

SEQ ID NO: 2348 - protein, 125 aa, unidentified; identical to SEQ ID NO: 2343
  REGION 1..125: note = Description of Unknown:uncultivated organism with predicted taxonomy: Planctomycetesbacterium
  REGION 1..125: note = MG4-109 RuvC-III domain

SEQ ID NO: 2349 - protein, 125 aa, unidentified; identical to SEQ ID NO: 2343
  REGION 1..125: note = Description of Unknown:uncultivated organism
  REGION 1..125: note = MG4-110 RuvC-III domain

SEQ ID NO: 2350 - protein, 125 aa, unidentified
  REGION 1..125: note = Description of Unknown:uncultivated organism with predicted taxonomy: Planctomycetesbacterium
  REGION 1..125: note = MG4-111 RuvC-III domain
NDTRYASKLATEYLALLYGGRNDRNGVQRIQCSAGGCTAVVRRAWGGNYLLGEGEKVRGDHRHHAIDALTIAVTSPAIVKLIAGVKGEDRRRAIEEKRPLVVTDLYTQAKAKLDSAGISHHTVNK

SEQ ID NO: 2351 - protein, 125 aa, unidentified; identical to SEQ ID NO: 2343
  REGION 1..125: note = Description of Unknown:uncultivated organism
  REGION 1..125: note = MG4-112 RuvC-III domain

SEQ ID NO: 2352 - protein, 125 aa, unidentified; identical to SEQ ID NO: 2345
  REGION 1..125: note = Description of Unknown:uncultivated organism
  REGION 1..125: note = MG4-113 RuvC-III domain

SEQ ID NO: 2353 - protein, 125 aa, unidentified; identical to SEQ ID NO: 2343
  REGION 1..125: note = Description of Unknown:uncultivated organism
  REGION 1..125: note = MG4-114 RuvC-III domain

SEQ ID NO: 2354 - protein, 125 aa, unidentified; identical to SEQ ID NO: 2343
  REGION 1..125: note = Description of Unknown:uncultivated organism
  REGION 1..125: note = MG4-115 RuvC-III domain

SEQ ID NO: 2355 - protein, 141 aa, unidentified
  REGION 1..141: note = Description of Unknown:uncultivated organism
  REGION 1..141: note = MG4-116 RuvC-III domain
NDTRYSSRLACDLIAKLYGGRVIETETGTRQVVFASSGMVTATLRKGLGLEAVLCEASGSSNGETRGKSRTDHRHHAIDALTIALTRQSMIQTMSRTASLEPNWAITSRSLRTIPSPWSNFIDSVRPHVQELLVSHRPEHR

SEQ ID NO: 2356 - protein, 140 aa, unidentified
  REGION 1..140: note = Description of Unknown:uncultivated organism with predicted taxonomy:Acidobacteriales bacterium 59-55
  REGION 1..140: note = MG4-117 RuvC-III domain
NDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHK

SEQ ID NO: 2357 - protein, 141 aa, unidentified; identical to SEQ ID NO: 2355
  REGION 1..141: note = Description of Unknown:uncultivated organism
  REGION 1..141: note = MG4-118 RuvC-III domain

SEQ ID NO: 2358 - protein, 140 aa, unidentified; identical to SEQ ID NO: 2356
  REGION 1..140: note = Description of Unknown:uncultivated organism
  REGION 1..140: note = MG4-119 RuvC-III domain

SEQ ID NO: 2359 - protein, 141 aa, unidentified; identical to SEQ ID NO: 2355
  REGION 1..141: note = Description of Unknown:uncultivated organism
  REGION 1..141: note = MG4-120 RuvC-III domain

SEQ ID NO: 2360 - protein, 140 aa, unidentified
  REGION 1..140: note = Description of Unknown:uncultivated organism with predicted taxonomy:Acidobacteriales bacterium 59-55
  REGION 1..140: note = MG4-121 RuvC-III domain
NDTRYASVLASRFLGALYGGRDLVDAEKVRQVIFASSGAVTATLRSSWGLEAILREIVPTEPGEPRGKPRTDHRHHAIDAITIALTRPKVIQSMALAASLEPWQRDSRAWRKIESPWRDFVLSIRPHIEQMLVSHRPEHK

SEQ ID NO: 2361 - protein, 140 aa, unidentified
  REGION 1..140: note = Description of Unknown:uncultivated organism with predicted taxonomy: unculturedbacterium
  REGION 1..140: note = MG4-122 RuvC-III domain
NDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHK

SEQ ID NO: 2362 - protein, 141 aa, unidentified; identical to SEQ ID NO: 2355
  REGION 1..141: note = Description of Unknown:uncultivated organism
  REGION 1..141: note = MG4-123 RuvC-III domain

SEQ ID NO: 2363 - protein, 141 aa, unidentified; identical to SEQ ID NO: 2355
  REGION 1..141: note = Description of Unknown:uncultivated organism
  REGION 1..141: note = MG4-124 RuvC-III domain

SEQ ID NO: 2364 - protein, 141 aa, unidentified; identical to SEQ ID NO: 2355
  REGION 1..141: note = Description of Unknown:uncultivated organism
  REGION 1..141: note = MG4-125 RuvC-III domain

SEQ ID NO: 2365 - protein, 141 aa, unidentified
  REGION 1..141: note = Description of Unknown:uncultivated organism
  REGION 1..141: note = MG4-126 RuvC-III domain
NDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHR

SEQ ID NO: 2366 - protein, 140 aa, unidentified; identical to SEQ ID NO: 2361
  REGION 1..140: note = Description of Unknown:uncultivated organism
  REGION 1..140: note = MG4-127 RuvC-III domain

SEQ ID NO: 2367 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-128 RuvC-III domain

SEQ ID NO: 2368 - protein, 142 aa, unidentified
  REGION 1..142: note = Description of Unknown:uncultivated organism
  REGION 1..142: note = MG4-129 RuvC-III domain
NDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHK

SEQ ID NO: 2369 - protein, 132 aa, unidentified
  REGION 1..132: note = Description of Unknown:uncultivated organism with predicted taxonomy: Planctomycetes
  REGION 1..132: note = MG4-130 RuvC-III domain
QDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRR

SEQ ID NO: 2370 - protein, 140 aa, unidentified; identical to SEQ ID NO: 2356
  REGION 1..140: note = Description of Unknown:uncultivated organism
  REGION 1..140: note = MG4-131 RuvC-III domain

SEQ ID NO: 2371 - protein, 128 aa, unidentified
  REGION 1..128: note = Description of Unknown:uncultivated organism with predicted taxonomy: Planctomycetesbacterium
  REGION 1..128: note = MG4-132 RuvC-III domain
NDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQ

SEQ ID NO: 2372 - protein, 99 aa, unidentified
  REGION 1..99: note = Description of Unknown:uncultivated organism
  REGION 1..99: note = MG4-133 RuvC-III domain
NDTRYACKLACELVGTLYGGRDEKTDTDSRQVVFASSGMVTATLRKSWGLEAIMRETAPSANGQNHGKPRTDHRHHAIDAITIALSRPKMIATLSRNNA

SEQ ID NO: 2373 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-134 RuvC-III domain

SEQ ID NO: 2374 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-135 RuvC-III domain

SEQ ID NO: 2375 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-136 RuvC-III domain

SEQ ID NO: 2376 - protein, 142 aa, unidentified
  REGION 1..142: note = Description of Unknown:uncultivated organism with predicted taxonomy:Acidobacteriales bacterium 59-55
  REGION 1..142: note = MG4-137 RuvC-III domain
NDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQQVAEVLTSHRPEHK

SEQ ID NO: 2377 - protein, 142 aa, unidentified
  REGION 1..142: note = Description of Unknown:uncultivated organism with predicted taxonomy: unculturedbacterium
  REGION 1..142: note = MG4-138 RuvC-III domain
NDTRYASKLACELVGTLYGGRDVPLKDGKSRQVVFASSGMVTSTLRKGWGLEAILREAAPSANGQNRGKPRTDHRHHAIDAITIALSRPKMIAALSRNNAQDPYWPNNGRTTPKIQSPWKDFVDSIRPHFEQMLVSHRPEHR

SEQ ID NO: 2378 - protein, 135 aa, unidentified
  REGION 1..135: note = Description of Unknown:uncultivated organism
  REGION 1..135: note = MG4-139 RuvC-III domain
NCIRYASQMACKLMGTLYGGRDMETAGRSRQIIFASTGMLTGTLRRAWGLEAILREETPSSIEGKPRNDYRHHAIDAIAVALSHPKLIAALSRSDDSYAWATRALLKIESPWKNFIDSIRPHFDQMLISHRPEHR

SEQ ID NO: 2379 - protein, 172 aa, unidentified
  REGION 1..172: note = Description of Unknown:uncultivated organism with predicted taxonomy: Planctomycetesbacterium
  REGION 1..172: note = MG4-140 RuvC-III domain
NDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRRIVVSRRPEHK

SEQ ID NO: 2380 - protein, 141 aa, unidentified; identical to SEQ ID NO: 2365
  REGION 1..141: note = Description of Unknown:uncultivated organism
  REGION 1..141: note = MG4-141 RuvC-III domain

SEQ ID NO: 2381 - protein, 62 aa, unidentified
  REGION 1..62: note = Description of Unknown:uncultivated organism with predicted taxonomy: Polaribactersp. ALD11
  REGION 1..62: note = MG4-142 RuvC-III domain
NDTRYTSLLAARLLSTLYGGRDVAENGGKRQIIFASTGAVTATLRRNWGFEQILRNIIPPEP

SEQ ID NO: 2382 - protein, 140 aa, unidentified; identical to SEQ ID NO: 2356
  REGION 1..140: note = Description of Unknown:uncultivated organism
  REGION 1..140: note = MG4-143 RuvC-III domain

SEQ ID NO: 2383 - protein, 140 aa, unidentified; identical to SEQ ID NO: 2361
  REGION 1..140: note = Description of Unknown:uncultivated organism
  REGION 1..140: note = MG4-144 RuvC-III domain

SEQ ID NO: 2384 - protein, 66 aa, unidentified
  REGION 1..66: note = Description of Unknown:uncultivated organism
  REGION 1..66: note = MG4-145 RuvC-III domain
NDTRYACKLACELVGTLYGGRDEKTDTDSRQVVFASSGMVTATLRKSWGLEAIMRETAPSANGQNH

SEQ ID NO: 2385 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-146 RuvC-III domain

SEQ ID NO: 2386 - protein, 141 aa, unidentified; identical to SEQ ID NO: 2365
  REGION 1..141: note = Description of Unknown:uncultivated organism
  REGION 1..141: note = MG4-147 RuvC-III domain

SEQ ID NO: 2387 - protein, 140 aa, unidentified; identical to SEQ ID NO: 2356
  REGION 1..140: note = Description of Unknown:uncultivated organism
  REGION 1..140: note = MG4-148 RuvC-III domain

SEQ ID NO: 2388 - protein, 140 aa, unidentified; identical to SEQ ID NO: 2356
  REGION 1..140: note = Description of Unknown:uncultivated organism
  REGION 1..140: note = MG4-149 RuvC-III domain

SEQ ID NO: 2389 - protein, 142 aa, unidentified
  REGION 1..142: note = Description of Unknown:uncultivated organism with predicted taxonomy: Polaribactersp. ALD11
  REGION 1..142: note = MG4-150 RuvC-III domain
NDTRYTSLLAARLLSTLYGGRDLAENGRKRQIIFASSGAVTATLRRNWGFEQILRNIIPPEPNESSGKPRTDHRHHAIDAIVIALTRNDVIQAMARASALEPWQPGTRSWRHVPQPWHTPNFFRSVEEQVREMLTSHRPEHK

SEQ ID NO: 2390 - protein, 142 aa, unidentified; identical to SEQ ID NO: 2376
  REGION 1..142: note = Description of Unknown:uncultivated organism with predicted taxonomy:Acidobacteriales
  REGION 1..142: note = MG4-151 RuvC-III domain

SEQ ID NO: 2391 - protein, 141 aa, unidentified; identical to SEQ ID NO: 2365
  REGION 1..141: note = Description of Unknown:uncultivated organism
  REGION 1..141: note = MG4-152 RuvC-III domain

SEQ ID NO: 2392 - protein, 140 aa, unidentified; identical to SEQ ID NO: 2356
  REGION 1..140: note = Description of Unknown:uncultivated organism
  REGION 1..140: note = MG4-153 RuvC-III domain

SEQ ID NO: 2393 - protein, 140 aa, unidentified
  REGION 1..140: note = Description of Unknown:uncultivated organism with predicted taxonomy:Acidobacteriales bacterium 59-55
  REGION 1..140: note = MG4-154 RuvC-III domain
NDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHK

SEQ ID NO: 2394 - protein, 127 aa, unidentified
  REGION 1..127: note = Description of Unknown:uncultivated organism with predicted taxonomy:Deltaproteobacteria
  REGION 1..127: note = MG4-155 RuvC-III domain
NDTRYASKLAARYMACLYGGLSDSCGQRIFVSPGQVTAFLRRLWAIEGLLSGGGGKSRDDHRHHAIDAVVVALTGPAWVKALSDAASRAREEGRRRFASLEAPWPGFAAAVQDRLQGLTVSHRANLK

SEQ ID NO: 2395 - protein, 131 aa, unidentified
  REGION 1..131: note = Description of Unknown:uncultivated organism with predicted taxonomy: Planctomycetesbacterium
  REGION 1..131: note = MG4-156 RuvC-III domain
NDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHH

SEQ ID NO: 2396 - protein, 140 aa, unidentified; identical to SEQ ID NO: 2356
  REGION 1..140: note = Description of Unknown:uncultivated organism
  REGION 1..140: note = MG4-157 RuvC-III domain

SEQ ID NO: 2397 - protein, 140 aa, unidentified; identical to SEQ ID NO: 2356
  REGION 1..140: note = Description of Unknown:uncultivated organism
  REGION 1..140: note = MG4-158 RuvC-III domain

SEQ ID NO: 2398 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-159 RuvC-III domain

SEQ ID NO: 2399 - protein, 132 aa, unidentified; identical to SEQ ID NO: 2369
  REGION 1..132: note = Description of Unknown:uncultivated organism with predicted taxonomy: Planctomycetes
  REGION 1..132: note = MG4-160 RuvC-III domain

SEQ ID NO: 2400 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-161 RuvC-III domain

SEQ ID NO: 2401 - protein, 141 aa, unidentified; identical to SEQ ID NO: 2262
  REGION 1..141: note = Description of Unknown:uncultivated organism
  REGION 1..141: note = MG4-162 RuvC-III domain

SEQ ID NO: 2402 - protein, 142 aa, unidentified
  REGION 1..142: note = Description of Unknown:uncultivated organism with predicted taxonomy:Acidobacteriales bacterium 59-55
  REGION 1..142: note = MG4-163 RuvC-III domain
NDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWRTPDFFRSVEEQVREMLTSHRPEHK

SEQ ID NO: 2403 - protein, 141 aa, unidentified; identical to SEQ ID NO: 2365
  REGION 1..141: note = Description of Unknown:uncultivated organism
  REGION 1..141: note = MG4-164 RuvC-III domain

SEQ ID NO: 2404 - protein, 140 aa, unidentified; identical to SEQ ID NO: 2356
  REGION 1..140: note = Description of Unknown:uncultivated organism
  REGION 1..140: note = MG4-165 RuvC-III domain

SEQ ID NO: 2405 - protein, 140 aa, unidentified; identical to SEQ ID NO: 2393
  REGION 1..140: note = Description of Unknown:uncultivated organism with predicted taxonomy: CandidatusSulfotelmatomonas gaucii
  REGION 1..140: note = MG4-166 RuvC-III domain

SEQ ID NO: 2406 - protein, 142 aa, unidentified; identical to SEQ ID NO: 2376
  REGION 1..142: note = Description of Unknown:uncultivated organism with predicted taxonomy:Acidobacteriales bacterium 59-55
  REGION 1..142: note = MG4-167 RuvC-III domain

SEQ ID NO: 2407 - protein, 141 aa, unidentified; identical to SEQ ID NO: 2365
  REGION 1..141: note = Description of Unknown:uncultivated organism
  REGION 1..141: note = MG4-168 RuvC-III domain

SEQ ID NO: 2408 - protein, 140 aa, unidentified; identical to SEQ ID NO: 2356
  REGION 1..140: note = Description of Unknown:uncultivated organism
  REGION 1..140: note = MG4-169 RuvC-III domain

SEQ ID NO: 2409 - protein, 141 aa, unidentified; identical to SEQ ID NO: 2365
  REGION 1..141: note = Description of Unknown:uncultivated organism
  REGION 1..141: note = MG4-170 RuvC-III domain

SEQ ID NO: 2410 - protein, 140 aa, unidentified; identical to SEQ ID NO: 2356
  REGION 1..140: note = Description of Unknown:uncultivated organism
  REGION 1..140: note = MG4-171 RuvC-III domain

SEQ ID NO: 2411 - protein, 140 aa, unidentified; identical to SEQ ID NO: 2356
  REGION 1..140: note = Description of Unknown:uncultivated organism
  REGION 1..140: note = MG4-172 RuvC-III domain

SEQ ID NO: 2412 - protein, 128 aa, unidentified
  REGION 1..128: note = Description of Unknown:uncultivated organism with predicted taxonomy:Ignavibacteriales bacterium CG_4_9_14_3_um_filter_30_11
  REGION 1..128: note = MG4-173 RuvC-III domain
QDTRYASKLACRYLGVLYGGTSDASGNQRVFASAGQVTAKLRRAWDLDRILSPDKPEKSRDDHRHHAIDALTVALSSTTLIRALATAAGEADRLFRRKIILPVPWVGFGEQARSAVENIQPSHRPMRK

SEQ ID NO: 2413 - protein, 78 aa, unidentified
  REGION 1..78: note = Description of Unknown:uncultivated organism with predicted taxonomy: unculturedbacterium
  REGION 1..78: note = MG4-174 RuvC-III domain
NDTRYASKLACELVGTLYGGRDVPLKDGKSRQVVFASSGMVTSTLRKGWGLEAILREAAPSANGQNRGKPRTDHRHHA

SEQ ID NO: 2414 - protein, 141 aa, unidentified; identical to SEQ ID NO: 2365
  REGION 1..141: note = Description of Unknown:uncultivated organism
  REGION 1..141: note = MG4-175 RuvC-III domain

SEQ ID NO: 2415 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-176 RuvC-III domain

SEQ ID NO: 2416 - protein, 172 aa, unidentified
  REGION 1..172: note = Description of Unknown:uncultivated organism
  REGION 1..172: note = MG4-177 RuvC-III domain
NDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHK

SEQ ID NO: 2417 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-178 RuvC-III domain

SEQ ID NO: 2418 - protein, 142 aa, unidentified; identical to SEQ ID NO: 2368
  REGION 1..142: note = Description of Unknown:uncultivated organism with predicted taxonomy: Acidobacteria
  REGION 1..142: note = MG4-179 RuvC-III domain

SEQ ID NO: 2419 - protein, 140 aa, unidentified; identical to SEQ ID NO: 2361
  REGION 1..140: note = Description of Unknown:uncultivated organism
  REGION 1..140: note = MG4-180 RuvC-III domain

SEQ ID NO: 2420 - protein, 141 aa, unidentified; identical to SEQ ID NO: 2365
  REGION 1..141: note = Description of Unknown:uncultivated organism
  REGION 1..141: note = MG4-181 RuvC-III domain

SEQ ID NO: 2421 - protein, 140 aa, unidentified; identical to SEQ ID NO: 2356
  REGION 1..140: note = Description of Unknown:uncultivated organism
  REGION 1..140: note = MG4-182 RuvC-III domain

SEQ ID NO: 2422 - protein, 80 aa, unidentified
  REGION 1..80: note = Description of Unknown:uncultivated organism
  REGION 1..80: note = MG4-183 RuvC-III domain
NDTRYASKLACELVGTLYGGRDVPLKDGKSRQVVFASSGMVTSTLRKGWGLEAILREAAPSANGQNRGKPRTDHRHHAID

SEQ ID NO: 2423 - protein, 140 aa, unidentified; identical to SEQ ID NO: 2361
  REGION 1..140: note = Description of Unknown:uncultivated organism
  REGION 1..140: note = MG4-184 RuvC-III domain

SEQ ID NO: 2424 - protein, 140 aa, unidentified; identical to SEQ ID NO: 2356
  REGION 1..140: note = Description of Unknown:uncultivated organism
  REGION 1..140: note = MG4-185 RuvC-III domain

SEQ ID NO: 2425 - protein, 141 aa, unidentified; identical to SEQ ID NO: 2365
  REGION 1..141: note = Description of Unknown:uncultivated organism
  REGION 1..141: note = MG4-186 RuvC-III domain

SEQ ID NO: 2426 - protein, 92 aa, unidentified
  REGION 1..92: note = Description of Unknown:uncultivated organism with predicted taxonomy: Polaribactersp. ALD11
  REGION 1..92: note = MG4-187 RuvC-III domain
NDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 2427 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-188 RuvC-III domain

SEQ ID NO: 2428 - protein, 142 aa, unidentified; identical to SEQ ID NO: 2368
  REGION 1..142: note = Description of Unknown:uncultivated organism with predicted taxonomy: Polaribactersp. ALD11
  REGION 1..142: note = MG4-189 RuvC-III domain

SEQ ID NO: 2429 - protein, 140 aa, unidentified; identical to SEQ ID NO: 2361
  REGION 1..140: note = Description of Unknown:uncultivated organism
  REGION 1..140: note = MG4-190 RuvC-III domain

SEQ ID NO: 2430 - protein, 141 aa, unidentified; identical to SEQ ID NO: 2365
  REGION 1..141: note = Description of Unknown:uncultivated organism
  REGION 1..141: note = MG4-191 RuvC-III domain

SEQ ID NO: 2431 - protein, 140 aa, unidentified; identical to SEQ ID NO: 2356
  REGION 1..140: note = Description of Unknown:uncultivated organism
  REGION 1..140: note = MG4-192 RuvC-III domain

SEQ ID NO: 2432 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-193 RuvC-III domain

SEQ ID NO: 2433 - protein, 141 aa, unidentified; identical to SEQ ID NO: 2365
  REGION 1..141: note = Description of Unknown:uncultivated organism
  REGION 1..141: note = MG4-194 RuvC-III domain

SEQ ID NO: 2434 - protein, 140 aa, unidentified; identical to SEQ ID NO: 2356
  REGION 1..140: note = Description of Unknown:uncultivated organism
  REGION 1..140: note = MG4-195 RuvC-III domain

SEQ ID NO: 2435 - protein, 142 aa, unidentified; identical to SEQ ID NO: 2368
  REGION 1..142: note = Description of Unknown:uncultivated organism with predicted taxonomy:Acidobacteriales bacterium 59-55
  REGION 1..142: note = MG4-196 RuvC-III domain

SEQ ID NO: 2436 - protein, 140 aa, unidentified; identical to SEQ ID NO: 2356
  REGION 1..140: note = Description of Unknown:uncultivated organism
  REGION 1..140: note = MG4-197 RuvC-III domain

SEQ ID NO: 2437 - protein, 131 aa, unidentified; identical to SEQ ID NO: 2395
  REGION 1..131: note = Description of Unknown:uncultivated organism
  REGION 1..131: note = MG4-198 RuvC-III domain

SEQ ID NO: 2438 - protein, 141 aa, unidentified; identical to SEQ ID NO: 2365
  REGION 1..141: note = Description of Unknown:uncultivated organism
  REGION 1..141: note = MG4-199 RuvC-III domain

SEQ ID NO: 2439 - protein, 141 aa, unidentified; identical to SEQ ID NO: 2365
  REGION 1..141: note = Description of Unknown:uncultivated organism
  REGION 1..141: note = MG4-200 RuvC-III domain

SEQ ID NO: 2440 - protein, 142 aa, unidentified; identical to SEQ ID NO: 2368
  REGION 1..142: note = Description of Unknown:uncultivated organism with predicted taxonomy:Acidobacteriales bacterium 59-55
  REGION 1..142: note = MG4-201 RuvC-III domain

SEQ ID NO: 2441 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-202 RuvC-III domain

SEQ ID NO: 2442 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-203 RuvC-III domain

SEQ ID NO: 2443 - protein, 140 aa, unidentified; identical to SEQ ID NO: 2356
  REGION 1..140: note = Description of Unknown:uncultivated organism with predicted taxonomy:Acidobacteriales bacterium 59-55
  REGION 1..140: note = MG4-204 RuvC-III domain

SEQ ID NO: 2444 - protein, 128 aa, unidentified
  REGION 1..128: note = Description of Unknown:uncultivated organism with predicted taxonomy: Acidobacteria
  REGION 1..128: note = MG4-205 RuvC-III domain
QDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRK

SEQ ID NO: 2445 - protein, 140 aa, unidentified; identical to SEQ ID NO: 2356
  REGION 1..140: note = Description of Unknown:uncultivated organism
  REGION 1..140: note = MG4-206 RuvC-III domain

SEQ ID NO: 2446 - protein, 128 aa, unidentified; identical to SEQ ID NO: 2444
  REGION 1..128: note = Description of Unknown:uncultivated organism
  REGION 1..128: note = MG4-207 RuvC-III domain

SEQ ID NO: 2447 - protein, 140 aa, unidentified; identical to SEQ ID NO: 2361
  REGION 1..140: note = Description of Unknown:uncultivated organism
  REGION 1..140: note = MG4-208 RuvC-III domain

SEQ ID NO: 2448 - protein, 141 aa, unidentified; identical to SEQ ID NO: 2365
  REGION 1..141: note = Description of Unknown:uncultivated organism
  REGION 1..141: note = MG4-209 RuvC-III domain

SEQ ID NO: 2449 - protein, 167 aa, unidentified
  REGION 1..167: note = Description of Unknown:uncultivated organism with predicted taxonomy: candidatedivision Kazan bacterium
  REGION 1..167: note = MG4-210 RuvC-III domain
NDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSH

SEQ ID NO: 2450 - protein, 142 aa, unidentified; identical to SEQ ID NO: 2368
  REGION 1..142: note = Description of Unknown:uncultivated organism with predicted taxonomy:Acidobacteriales bacterium 59-55
  REGION 1..142: note = MG4-211 RuvC-III domain

SEQ ID NO: 2451 - protein, 140 aa, unidentified; identical to SEQ ID NO: 2361
  REGION 1..140: note = Description of Unknown:uncultivated organism
  REGION 1..140: note = MG4-212 RuvC-III domain

SEQ ID NO: 2452 - protein, 142 aa, unidentified; identical to SEQ ID NO: 2368
  REGION 1..142: note = Description of Unknown:uncultivated organism with predicted taxonomy: Polaribactersp. ALD11
  REGION 1..142: note = MG4-213 RuvC-III domain

SEQ ID NO: 2453 - protein, 141 aa, unidentified; identical to SEQ ID NO: 2365
  REGION 1..141: note = Description of Unknown:uncultivated organism
  REGION 1..141: note = MG4-214 RuvC-III domain

SEQ ID NO: 2454 - protein, 172 aa, unidentified; identical to SEQ ID NO: 2416
  REGION 1..172: note = Description of Unknown:uncultivated organism
  REGION 1..172: note = MG4-215 RuvC-III domain

SEQ ID NO: 2455 - protein, 140 aa, unidentified; identical to SEQ ID NO: 2356
  REGION 1..140: note = Description of Unknown:uncultivated organism
  REGION 1..140: note = MG4-216 RuvC-III domain

SEQ ID NO: 2456 - protein, 80 aa, unidentified
  REGION 1..80: note = Description of Unknown:uncultivated organism with predicted taxonomy: candidatedivision Zixibacteria bacterium CG_4_9_14_3_um_filter_46_8
  REGION 1..80: note = MG4-217 RuvC-III domain
SDTRYASKLAMRYLALLYGGLSDEGGTQRIQAGSGNVTKHVRQAHRLNGILGDGPGKNRNDHRHHAVDALAIALTDQALV

SEQ ID NO: 2457 - protein, 128 aa, unidentified
  REGION 1..128: note = Description of Unknown:uncultivated organism with predicted taxonomy:Planctomicrobium piriforme
  REGION 1..128: note = MG4-218 RuvC-III domain
NDTRYATRQATDYLALLYGGLYEKGGKRFIQAAKGGTTAYLRNEWQLNSILGDGGTKSRDDHRHHAVDAVAIALTDAGTVKMLSDAAGRAAQEGRRRFGRVEDPWPGFLDDVRQAIEGLNVSHRVSRK

SEQ ID NO: 2458 - protein, 140 aa, unidentified; identical to SEQ ID NO: 2393
  REGION 1..140: note = Description of Unknown:uncultivated organism with predicted taxonomy: CandidatusSulfotelmatomonas gaucii
  REGION 1..140: note = MG4-219 RuvC-III domain

SEQ ID NO: 2459 - protein, 135 aa, unidentified
  REGION 1..135: note = Description of Unknown:uncultivated organism with predicted taxonomy: Proteobacteria
  REGION 1..135: note = MG4-220 RuvC-III domain
NDTRYASTMAGDYLGFLYGGKIDSQRNLRVRATTGQVTAYLRDEWMLNRILRDGPTEQGGKVAKSREDHRHHAVDAIAIALTDESTIQQLSRAAQQAPQLGRRRFAPVQAPWPDFVDSVRAEIGRIVVSHRPNRK

SEQ ID NO: 2460 - protein, 142 aa, unidentified; identical to SEQ ID NO: 2368
  REGION 1..142: note = Description of Unknown:uncultivated organism with predicted taxonomy:Acidobacteriales bacterium 59-55
  REGION 1..142: note = MG4-221 RuvC-III domain

SEQ ID NO: 2461 - protein, 140 aa, unidentified; identical to SEQ ID NO: 2356
  REGION 1..140: note = Description of Unknown:uncultivated organism
  REGION 1..140: note = MG4-222 RuvC-III domain

SEQ ID NO: 2462 - protein, 141 aa, unidentified; identical to SEQ ID NO: 2365
  REGION 1..141: note = Description of Unknown:uncultivated organism
  REGION 1..141: note = MG4-223 RuvC-III domain

SEQ ID NO: 2463 - protein, 140 aa, unidentified; identical to SEQ ID NO: 2361
  REGION 1..140: note = Description of Unknown:uncultivated organism
  REGION 1..140: note = MG4-224 RuvC-III domain

SEQ ID NO: 2464 - protein, 172 aa, unidentified
  REGION 1..172: note = Description of Unknown:uncultivated organism
  REGION 1..172: note = MG4-225 RuvC-III domain
NDTLYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHK

SEQ ID NO: 2465 - protein, 92 aa, unidentified; identical to SEQ ID NO: 2426
  REGION 1..92: note = Description of Unknown:uncultivated organism with predicted taxonomy: Polaribactersp. ALD11
  REGION 1..92: note = MG4-226 RuvC-III domain

SEQ ID NO: 2466 - protein, 141 aa, unidentified; identical to SEQ ID NO: 2365
  REGION 1..141: note = Description of Unknown:uncultivated organism
  REGION 1..141: note = MG4-227 RuvC-III domain

SEQ ID NO: 2467 - protein, 130 aa, unidentified
  REGION 1..130: note = Description of Unknown:uncultivated organism
  REGION 1..130: note = MG4-247 RuvC-III domain
PDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRK

SEQ ID NO: 2468 - protein, 130 aa, unidentified; identical to SEQ ID NO: 2467
  REGION 1..130: note = Description of Unknown:uncultivated organism with predicted taxonomy: Planctomycetes
  REGION 1..130: note = MG4-248 RuvC-III domain

SEQ ID NO: 2469 - protein, 135 aa, unidentified
  REGION 1..135: note = Description of Unknown:uncultivated organism with predicted taxonomy: Fuerstiamarisgermanicae
  REGION 1..135: note = MG4-249 RuvC-III domain
QDTAYASKLAKRYLGLLYGGEIDNLGKRRVTATSGMVTWDLRGGWDLNGILNDGRTSNGSTVVKTRDDHRHHAVDAVVIALTDDRSIQQLNKAAAMGQMQGKRGIIKLPSTWNNFVDTVRAEIGRIIVSHRVSKK

SEQ ID NO: 2470 - protein, 134 aa, unidentified
  REGION 1..134: note = Description of Unknown:uncultivated organism
  REGION 1..134: note = MG4-250 RuvC-III domain
NDTAYASKLACQYLGVLYGGVEDSTGKKRVKASSGGVTGYLRRLWNLNRILNDGPTKSGGFIPKTRDDHRHHAVDAVVIGLTDESVVHKLSRAAERGFYRGRPFAPLEGLWPNFVPSIKTEIDRVVVSHRVSKK

SEQ ID NO: 2471 - protein, 126 aa, unidentified
  REGION 1..126: note = Description of Unknown:uncultivated organism
  REGION 1..126: note = MG4-251 RuvC-III domain
NDTRYASRLAVKYLGMLYGGVIDAAGKQRVFATTGGATAIVRRAWGANFLLGEGEKVRDDHRHHAIDALTIALTTPDIVKIIAGMPEELRRAKGKTPDDTIIDNAVFKQAKEMLDKAAVSHHIVNK

SEQ ID NO: 2472 - protein, 125 aa, unidentified
  REGION 1..125: note = Description of Unknown:uncultivated organism with predicted taxonomy: Bdellovibrioexovorus
  REGION 1..125: note = MG4-252 RuvC-III domain
NDTRYASRLAMNYLGLLYGGAIDRNGKRRIQACSGGCTALIRRAWGANYLLGDGEKKREDHRHHAIDALTIAIITPEIVKTVANISKDEYKRRHMQNLPMLDDALYLQAEGKIDSATVSHHVVNK

SEQ ID NO: 2473 - protein, 126 aa, unidentified; identical to SEQ ID NO: 2471
  REGION 1..126: note = Description of Unknown:uncultivated organism
  REGION 1..126: note = MG4-253 RuvC-III domain

SEQ ID NO: 2474 - protein, 126 aa, unidentified
  REGION 1..126: note = Description of Unknown:uncultivated organism
  REGION 1..126: note = MG4-254 RuvC-III domain
NDTRYASRLAMQYLALLYGGIIDKTGKQRIFATSGSCTAMIRRAWGGNYLLGEGEKVRDDHRHHAIDALTIALTTPEMIKVIASMTREERSRKQKSCNDTIIDNEIFRQASADLDNIPVSHHVVNK

SEQ ID NO: 2475 - protein, 126 aa, unidentified; identical to SEQ ID NO: 2471
  REGION 1..126: note = Description of Unknown:uncultivated organism
  REGION 1..126: note = MG4-255 RuvC-III domain

SEQ ID NO: 2476 - protein, 126 aa, unidentified; identical to SEQ ID NO: 2471
  REGION 1..126: note = Description of Unknown:uncultivated organism
  REGION 1..126: note = MG4-256 RuvC-III domain

SEQ ID NO: 2477 - protein, 144 aa, unidentified
  REGION 1..144: note = Description of Unknown:uncultivated organism with predicted taxonomy: Planctomycetes
  REGION 1..144: note = MG4-257 RuvC-III domain
NDTKFASREAGDYLGLLYGGRVDADGNTRVQMTKGGITSELRNALQLGSIPSQVEDWICDPEEKRGKDRGDHRHHAIDAIAIALSSPGIIKPLMGAYSSSETAKKEMRRDIWASFAKKAAWPGFSDNVVEAVNSISISRRPKHR

SEQ ID NO: 2478 - protein, 145 aa, unidentified
  REGION 1..145: note = Description of Unknown:uncultivated organism
  REGION 1..145: note = MG4-258 RuvC-III domain
NDTRYVSKLAARYVGMLYGGRDVPQPDGAAKRVVFASTGMLTASLRRTWGLEAILREPEPAETSRKPGKQRTDNRHHAIDAIVIALTSNAVIQKASSVAATGSYGDAARAISRVQPPWGDFVGDFVDSIRPAIERMVVSHRPSHK

SEQ ID NO: 2479 - protein, 142 aa, unidentified
  REGION 1..142: note = Description of Unknown:uncultivated organism with predicted taxonomy: Acidobacteria
  REGION 1..142: note = MG4-259 RuvC-III domain
NDTRYTTRLAADLLGSLYGGRDETLPDGAKRRAIFATTGQVTATLRRVWNLESILREALPSANGESKGKPRTDHRHHAIDAIVVALTSQRTVQLLSMAAAQSVAGESRSRVFTGIQSPWPNFVDSIRPHIEQMIVSHRPEHK

SEQ ID NO: 2480 - protein, 141 aa, unidentified
  REGION 1..141: note = Description of Unknown:uncultivated organism with predicted taxonomy: Planctomycetesbacterium
  REGION 1..141: note = MG4-260 RuvC-III domain
NDTRYASKLACELVGSLFGGRDAQTENGSRQIVFASSGMVTATLRKGWGLEAILREAAPSANGQNRGKPRTDHRHHAIDAITIALSRPKMIATLSRNNAQDPYWPQNGRTAPRIQSPWKDFVGSIRPHFEQMLVSHRPEHR

SEQ ID NO: 2481 - protein, 125 aa, unidentified
  REGION 1..125: note = Description of Unknown:uncultivated organism
  REGION 1..125: note = MG4-261 RuvC-III domain
NDTRYASKLSMRYLAFLYGGIVDKNSIRRIFSVAGGCTALIRRAWGGNYLLGEGEKVRDDHRHHAIDAVTVALTTPELVQKIAKLSQEGRRKLNDSTKNFIDNDFYYQAQGMMDSCAVSHHQTNK

SEQ ID NO: 2482 - protein, 115 aa, unidentified
  REGION 1..115: note = Description of Unknown:uncultivated organism with predicted taxonomy: Planctomycetes
  REGION 1..115: note = MG6-7 RuvC-III domain
NDTRYITREILRYLKQLGCTVTGSRGKVTSELRHQWGLNSILESDLPGPKNREDHRHHAIDAVVTALTNQKHLHELAATKYAVAHDGFPVPWEGFRDAVAQAVNKIQVSHRVTRK

SEQ ID NO: 2483 - protein, 115 aa, unidentified
  REGION 1..115: note = Description of Unknown:uncultivated organism with predicted taxonomy: Planctomycetesbacterium
  REGION 1..115: note = MG6-8 RuvC-III domain
NDTRYISREVVKYLKQLGCIVTGTKGQITSELRHQWGLNNILDYTGAGLKNRDDHRHHAVDAVVTAVTEQKHLGGLAASKYDKSGIEFDPPWEGFREQVAEKINAINVSHRVTRK

SEQ ID NO: 2484 - protein, 115 aa, unidentified
  REGION 1..115: note = Description of Unknown:uncultivated organism
  REGION 1..115: note = MG6-9 RuvC-III domain
NDTRYICKEVVKYLKQLGVNVRGSKGRVTAELRHQWGLNSILDLNNSNMKNRDDHRHHAIDAVVTAVTKNEHLRRLAKSKYSKTDSSFSEPWEDFREELAEKVKHINVSHRVRRK

SEQ ID NO: 2485 - protein, 117 aa, unidentified
  REGION 1..117: note = Description of Unknown:uncultivated organism with predicted taxonomy: Planctomycetesbacterium
  REGION 1..117: note = MG6-10 RuvC-III domain
NDTRYICREAVRYLKQICSNVKGTRGKITSELRHQWGLNSILNLTDPNMKNRDDHRHHAIDAAVVAVTRNKHLRELAESKYAKTGSGVKFEAPWKDFREELAEKIKHINVSHRVTRK

SEQ ID NO: 2486 - protein, 115 aa, unidentified; identical to SEQ ID NO: 2483
  REGION 1..115: note = Description of Unknown:uncultivated organism with predicted taxonomy: Planctomycetesbacterium
  REGION 1..115: note = MG6-11 RuvC-III domain

SEQ ID NO: 2487 - protein, 115 aa, unidentified; identical to SEQ ID NO: 2484
  REGION 1..115: note = Description of Unknown:uncultivated organism
  REGION 1..115: note = MG6-12 RuvC-III domain

SEQ ID NO: 2488 - protein, 117 aa, unidentified; identical to SEQ ID NO: 2485
  REGION 1..117: note = Description of Unknown:uncultivated organism with predicted taxonomy: Planctomycetesbacterium
  REGION 1..117: note = MG6-13 RuvC-III domain

SEQ ID NO: 2489 - protein, 126 aa, unidentified
  REGION 1..126: note = Description of Unknown:uncultivated organism
  REGION 1..126: note = MG6-20 RuvC-III domain
NDTAYIAREVRQYLKCLYSEEELVRDESVVCTRGQVTSDLCWCWELNSILNPDDQRETKNRADLRHHAIDAIVVALTTRQRLFALSQVFAKKHSLAKAKHEPWPHFREDVENAVLAIKVSHRPRKR

SEQ ID NO: 2490 - protein, 159 aa, unidentified
  REGION 1..159: note = Description of Unknown:uncultivated organism with predicted taxonomy: Arcicellaaurantiaca
  REGION 1..159: note = MG7-2 RuvC-III domain
NETQYITKQVKAELDKICRTITVTSGGITDYLRHQWGVDDVLKNINLEKYEAAGKVSDEDYRDRQGHWRTRKKIADWSKRDDHRHHAIDALVIACTKPAYIKRLNDLNQEYDSYKEMKKDGGKMESLTKFPQPKMKGGFIQNVTKATENILISFKAGKK

SEQ ID NO: 2491 - protein, 95 aa, unidentified
  REGION 1..95: note = Description of Unknown:uncultivated organism with predicted taxonomy:Flavobacteriales
  REGION 1..95: note = MG7-5 RuvC-III domain
KETQYITKQVKAELDKICRKITVTSGGITDYLRHQWGVDDVLKNINLEKYEAAGKVHDEEYRDRQGHWRTRKKIADWSKREDHRHHAIDALGIAC

SEQ ID NO: 2492 - protein, 88 aa, unidentified
  REGION 1..88: note = Description of Unknown:uncultivated organism with predicted taxonomy: Arcicellaaurantiaca
  REGION 1..88: note = MG7-6 RuvC-III domain
NETQYITKQVKAELDKICKKITVTSGGITDYLRHQWGVDDVLKNINLEKYEAAEKVHDEEYRDRQGHWRTRKKIADWSKRDDHRHHAI

SEQ ID NO: 2493 - protein, 156 aa, unidentified
  REGION 1..156: note = Description of Unknown:uncultivated organism
  REGION 1..156: note = MG7-9 RuvC-III domain
RESQYIARKAVEVLREVCRNVYTTTGSITDFLRHRWGWDEVIPYLRLPQFKEAGLTEIIPVQNGQKTKEVIKGWSKRDDHRHHALDALVVACTRQSHIQRINELSPILAGTYGEERRQQLLDIVRDKYIAGKIPFSFRQVCEAMNQVLVSHKQRTR

SEQ ID NO: 2494 - protein, 158 aa, unidentified
  REGION 1..158: note = Description of Unknown:uncultivated organism with predicted taxonomy: Bacteroidetes
  REGION 1..158: note = MG7-10 RuvC-III domain
RETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLR

SEQ ID NO: 2495 - protein, 150 aa, unidentified
  REGION 1..150: note = Description of Unknown:uncultivated organism with predicted taxonomy: Bacteroidetes
  REGION 1..150: note = MG7-11 RuvC-III domain
RETAYISREVKNLLLGICRNVHSTSGTVTNYLRHIWGLDSILQELNIEKYRACGQTVKEIIGSNGSTKENERIVNWSKRDDHRHHAIDAIVIALTKQSHIQKLNNLNQEFQNYRELKQSAYNFPLPWATVHSDVLRTVSNILVSFKSGKK

SEQ ID NO: 2496 - protein, 158 aa, unidentified; identical to SEQ ID NO: 2494
  REGION 1..158: note = Description of Unknown:uncultivated organism with predicted taxonomy: Bacteroidetes
  REGION 1..158: note = MG7-12 RuvC-III domain

SEQ ID NO: 2497 - protein, 148 aa, unidentified
  REGION 1..148: note = Description of Unknown:uncultivated organism with predicted taxonomy:Deltaproteobacteria bacterium
  REGION 1..148: note = MG7-13 RuvC-III domain
KETQYITKVVREKLWEVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSR

SEQ ID NO: 2498 - protein, 148 aa, unidentified
  REGION 1..148: note = Description of Unknown:uncultivated organism with predicted taxonomy:Deltaproteobacteria bacterium
  REGION 1..148: note = MG7-14 RuvC-III domain
KETQYITKVVREKLREVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSR

SEQ ID NO: 2499 - protein, 137 aa, unidentified
  REGION 1..137: note = Description of Unknown:uncultivated organism with predicted taxonomy: Collinsella
  REGION 1..137: note = MG14-1 RuvC-III domain
TDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRK

SEQ ID NO: 2500 - protein, 126 aa, unidentified
  REGION 1..126: note = Description of Unknown:uncultivated organism
  REGION 1..126: note = MG14-3 RuvC-III domain
NDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRN

SEQ ID NO: 2501 - protein, 137 aa, unidentified
  REGION 1..137: note = Description of Unknown:uncultivated organism with predicted taxonomy:Coriobacteriales
  REGION 1..137: note = MG14-4 RuvC-III domain
TDTAYMSREVCSYLSDCLLFPEDGSKVHVVPTTGRATAWLRRRWGLNFGSTGEKDRTDDRHHATDACVIAACSRSLVIKTAKISQETHWSVTPGLTESQRKDARMKALESVMPWETFANEVRSRHDFVVPTRFVPRK

SEQ ID NO: 2502 - protein, 137 aa, unidentified; identical to SEQ ID NO: 2501
  REGION 1..137: note = Description of Unknown:uncultivated organism with predicted taxonomy: Actinobacteria
  REGION 1..137: note = MG14-5 RuvC-III domain

SEQ ID NO: 2503 - protein, 126 aa, unidentified; identical to SEQ ID NO: 2500
  REGION 1..126: note = Description of Unknown:uncultivated organism with predicted taxonomy: Collinsella
  REGION 1..126: note = MG14-6 RuvC-III domain

SEQ ID NO: 2504 - protein, 137 aa, unidentified
  REGION 1..137: note = Description of Unknown:uncultivated organism with predicted taxonomy: Collinsella
  REGION 1..137: note = MG14-7 RuvC-III domain
TDTAYMSREVCAYLADCLLFPDDGAKAHVVPTTGRTTAWLRRRWGLNFGLTGKKDRSDDRHHATDACVIAACSPSLVIKSAQINQKMHWSMTKGMSKAQRQDAIMKALENVMPWETFANEVRTVHKLIIPTRFVPRK

SEQ ID NO: 2505 - protein, 128 aa, unidentified
  REGION 1..128: note = Description of Unknown:uncultivated organism with predicted taxonomy: Olsenella
  REGION 1..128: note = MG14-8 RuvC-III domain
NDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHG

SEQ ID NO: 2506 - protein, 128 aa, unidentified
  REGION 1..128: note = Description of Unknown:uncultivated organism with predicted taxonomy: Olsenella sp.KH3B4
  REGION 1..128: note = MG14-9 RuvC-III domain
NDDRYMSVAVKNYLEDCLLFPEDGRKRHVIAVAGGATGNLRWVWGLNFGDGNVKDRTDDRHHAVDAAIIAACSESTVKKIAEASSKGREAFKKQRESRLADTQPWPTFADEVKARRAFVVPTRMADHG

SEQ ID NO: 2507 - protein, 137 aa, unidentified
  REGION 1..137: note = Description of Unknown:uncultivated organism with predicted taxonomy: Collinsella
  REGION 1..137: note = MG14-10 RuvC-III domain
TDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRK

SEQ ID NO: 2508 - protein, 103 aa, unidentified
  REGION 1..103: note = Description of Unknown:uncultivated organism with predicted taxonomy: Collinsella sp.AF20-14LB
  REGION 1..103: note = MG14-11 RuvC-III domain
NDTRYMSKDVAKWLADCLPFPKDGRRHVFCVSGAATGLMRRVWRIGILDENGKKDREDDRHHAVDAAVIAACTPSVVKSIALISEEHATHRDADRLLNRSLPY

SEQ ID NO: 2509 - protein, 137 aa, unidentified
  REGION 1..137: note = Description of Unknown:uncultivated organism with predicted taxonomy: Collinsella
  REGION 1..137: note = MG14-12 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRK

SEQ ID NO: 2510 - protein, 137 aa, unidentified; identical to SEQ ID NO: 2509
  REGION 1..137: note = Description of Unknown:uncultivated organism with predicted taxonomy: Collinsella
  REGION 1..137: note = MG14-13 RuvC-III domain

SEQ ID NO: 2511 - protein, 128 aa, unidentified
  REGION 1..128: note = Description of Unknown:uncultivated organism with predicted taxonomy: Olsenella
  REGION 1..128: note = MG14-14 RuvC-III domain
NDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHG

SEQ ID NO: 2512 - protein, 137 aa, unidentified; identical to SEQ ID NO: 2509
  REGION 1..137: note = Description of Unknown:uncultivated organism with predicted taxonomy:Coriobacteriales
  REGION 1..137: note = MG14-15 RuvC-III domain

SEQ ID NO: 2513 - protein, 126 aa, unidentified
  REGION 1..126: note = Description of Unknown:uncultivated organism with predicted taxonomy: Eggerthellales
  REGION 1..126: note = MG14-16 RuvC-III domain
NDTRYMSAALAKWLRECLPFARDGHEHVFCVAGGATALMRSVWDIGITGPDGKKNRDDDRHHAVDAAVIACCTPGIVKNVALVNEGHARADVRQRLFSDSLPYPEFKEQVNAWIPCIVPTLTLPNT

SEQ ID NO: 2514 - protein, 137 aa, unidentified; identical to SEQ ID NO: 2509
  REGION 1..137: note = Description of Unknown:uncultivated organism with predicted taxonomy: Collinsella
  REGION 1..137: note = MG14-17 RuvC-III domain

SEQ ID NO: 2515 - protein, 128 aa, unidentified; identical to SEQ ID NO: 2505
  REGION 1..128: note = Description of Unknown:uncultivated organism with predicted taxonomy: Olsenella
  REGION 1..128: note = MG14-18 RuvC-III domain

SEQ ID NO: 2516 - protein, 137 aa, unidentified; identical to SEQ ID NO: 2509
  REGION 1..137: note = Description of Unknown:uncultivated organism with predicted taxonomy:Coriobacteriales
  REGION 1..137: note = MG14-19 RuvC-III domain

SEQ ID NO: 2517 - protein, 137 aa, unidentified; identical to SEQ ID NO: 2509
  REGION 1..137: note = Description of Unknown:uncultivated organism with predicted taxonomy:Coriobacteriales
  REGION 1..137: note = MG14-20 RuvC-III domain

SEQ ID NO: 2518 - protein, 128 aa, unidentified; identical to SEQ ID NO: 2505
  REGION 1..128: note = Description of Unknown:uncultivated organism with predicted taxonomy: Olsenella sp.KH3B4
  REGION 1..128: note = MG14-21 RuvC-III domain

SEQ ID NO: 2519 - protein, 137 aa, unidentified; identical to SEQ ID NO: 2509
  REGION 1..137: note = Description of Unknown:uncultivated organism with predicted taxonomy: Collinsella
  REGION 1..137: note = MG14-22 RuvC-III domain

SEQ ID NO: 2520 - protein, 137 aa, unidentified; identical to SEQ ID NO: 2509
  REGION 1..137: note = Description of Unknown:uncultivated organism with predicted taxonomy: Collinsella
  REGION 1..137: note = MG14-23 RuvC-III domain

SEQ ID NO: 2521 - protein, 137 aa, unidentified
  REGION 1..137: note = Description of Unknown:uncultivated organism with predicted taxonomy: Collinsella
  REGION 1..137: note = MG14-24 RuvC-III domain
TDTAYMSREVCAYLADCLLFPEDGTKSHVVPTTGRATAWLRRRWGLNFGTNGEKDRSDDRHHATDACVIAACSRSLVIKTAKISEQTHWTVTKNLDKDERDHLRMKALENVMPWETFANEVRASHDFVIPTRFVPRK

SEQ ID NO: 2522 - protein, 128 aa, unidentified
  REGION 1..128: note = Description of Unknown:uncultivated organism with predicted taxonomy: Olsenella
  REGION 1..128: note = MG14-25 RuvC-III domain
NDDRYMSVAVKNYLEDCLLFPEDGRKRHVTAVAGGATGNLRWVWGLNFGEGNVKDRADDRHHAIDAAIIAACSESTVKKIAEASSKGREAFKKQRESRLADTQPWPTFADEVKARRAFVVPTRMADHG

SEQ ID NO: 2523 - protein, 137 aa, unidentified; identical to SEQ ID NO: 2509
  REGION 1..137: note = Description of Unknown:uncultivated organism with predicted taxonomy: Coriobacteriia
  REGION 1..137: note = MG14-26 RuvC-III domain

SEQ ID NO: 2524 - protein, 137 aa, unidentified; identical to SEQ ID NO: 2509
  REGION 1..137: note = Description of Unknown:uncultivated organism with predicted taxonomy: Collinsella
  REGION 1..137: note = MG14-27 RuvC-III domain

SEQ ID NO: 2525 - protein, 126 aa, unidentified
  REGION 1..126: note = Description of Unknown:uncultivated organism with predicted taxonomy: Collinsella
  REGION 1..126: note = MG14-28 RuvC-III domain
NDTRYMSKDVAKWLTDCLPFPEDGRKHVFCVSGVATALMRGIWRIGILDDDGKKNREDDRHHAVDAAVIAACTPSIVRGIALISEEHATHRDADRLLNRSLPYPEYRDQVKAWIPCIVPTYSPNRT

SEQ ID NO: 2526 - protein, 137 aa, unidentified; identical to SEQ ID NO: 2509
  REGION 1..137: note = Description of Unknown:uncultivated organism with predicted taxonomy:Coriobacteriales
  REGION 1..137: note = MG14-29 RuvC-III domain

SEQ ID NO: 2527 - protein, 137 aa, unidentified; identical to SEQ ID NO: 2509
  REGION 1..137: note = Description of Unknown:uncultivated organism with predicted taxonomy: Collinsella
  REGION 1..137: note = MG14-30 RuvC-III domain

SEQ ID NO: 2528 - protein, 123 aa, unidentified
  REGION 1..123: note = Description of Unknown:uncultivated organism with predicted taxonomy: Coriobacteriiabacterium
  REGION 1..123: note = MG14-31 RuvC-III domain
NDTRYASLAAKRYIEEYLTFKDNGKSRHVIAVAGGATAALRNAWGIRKDRSEDNLHHAVDASIIAACDESTVIAIAKASERKALTPKDKRKELFSRTEPWQDFANEVLSRKEHIIPSFMTDHK

SEQ ID NO: 2529 - protein, 128 aa, unidentified
  REGION 1..128: note = Description of Unknown:uncultivated organism with predicted taxonomy: Olsenella sp.KH3B4
  REGION 1..128: note = MG14-32 RuvC-III domain
NDDRYMSVAVKNYLEDCLLFPEDGRKRHVTAVAGGATGNLRWVWGLNFGEGNVKDRADDRHHAIDAAIIAACSESTVKKVAEASTKGREAFKQLRKSRLADTQPWPTFATEVAARREFVVPTRMADHG

SEQ ID NO: 2530 - protein, 137 aa, unidentified; identical to SEQ ID NO: 2509
  REGION 1..137: note = Description of Unknown:uncultivated organism with predicted taxonomy: Collinsella
  REGION 1..137: note = MG14-33 RuvC-III domain

SEQ ID NO: 2531 - protein, 128 aa, unidentified; identical to SEQ ID NO: 2505
  REGION 1..128: note = Description of Unknown:uncultivated organism with predicted taxonomy: Olsenella
  REGION 1..128: note = MG14-34 RuvC-III domain

SEQ ID NO: 2532 - protein, 128 aa, unidentified
  REGION 1..128: note = Description of Unknown:uncultivated organism with predicted taxonomy: Olsenella sp.KH3B4
  REGION 1..128: note = MG14-35 RuvC-III domain
NDDRYMSVAVKNYLEDCLLFPDSDRKRHVTAIAGGATGNLRWVWGLNSGSNNTKDRSDDRHHAVDAAVIAACSEATVQKVARARSLGRETFKHMRKSRLADTQPWPTFADEVIARKEFVIPTRMADHG

SEQ ID NO: 2533 - protein, 137 aa, unidentified
  REGION 1..137: note = Description of Unknown:uncultivated organism with predicted taxonomy:Coriobacteriales
  REGION 1..137: note = MG14-36 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2534 - protein, 126 aa, unidentified
  REGION 1..126: note = Description of Unknown:uncultivated organism with predicted taxonomy: Coprococcuscomes
  REGION 1..126: note = MG14-37 RuvC-III domain
NDTRYMSRQLAMWVRECLPFPDDRRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRT

SEQ ID NO: 2535 - protein, 137 aa, unidentified
  REGION 1..137: note = Description of Unknown:uncultivated organism with predicted taxonomy: Coriobacteriiabacterium
  REGION 1..137: note = MG14-38 RuvC-III domain
TDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRK

SEQ ID NO: 2536 - protein, 137 aa, unidentified; identical to SEQ ID NO: 2533
  REGION 1..137: note = Description of Unknown:uncultivated organism with predicted taxonomy: Collinsella
  REGION 1..137: note = MG14-39 RuvC-III domain

SEQ ID NO: 2537 - protein, 126 aa, unidentified
  REGION 1..126: note = Description of Unknown:uncultivated organism
  REGION 1..126: note = MG14-40 RuvC-III domain
NDTRYMSRQLAMWVRECLPFPDDKRQHVFCVAGAATSLMRRIWGIGVVDEKGKTDRSDDRHHAVDGAVIACCSPEIVKGIARVNSGRSNIKERERLRYESMPYPEFKDQVEAWIPCIVPTRTVSRT

SEQ ID NO: 2538 - protein, 137 aa, unidentified
  REGION 1..137: note = Description of Unknown:uncultivated organism with predicted taxonomy: Collinsella
  REGION 1..137: note = MG14-41 RuvC-III domain
TDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRK

SEQ ID NO: 2539 - protein, 137 aa, unidentified; identical to SEQ ID NO: 2533
  REGION 1..137: note = Description of Unknown:uncultivated organism with predicted taxonomy: Collinsella
  REGION 1..137: note = MG14-42 RuvC-III domain

SEQ ID NO: 2540 - protein, 137 aa, unidentified
  REGION 1..137: note = Description of Unknown:uncultivated organism with predicted taxonomy: Collinsella
  REGION 1..137: note = MG14-43 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRK

SEQ ID NO: 2541 - protein, 137 aa, unidentified
  REGION 1..137: note = Description of Unknown:uncultivated organism with predicted taxonomy: Olsenellamediterranea
  REGION 1..137: note = MG14-44 RuvC-III domain
TDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRK

SEQ ID NO: 2542 - protein, 137 aa, unidentified; identical to SEQ ID NO: 2538
  REGION 1..137: note = Description of Unknown:uncultivated organism with predicted taxonomy: Collinsella
  REGION 1..137: note = MG14-45 RuvC-III domain

SEQ ID NO: 2543 - protein, 137 aa, unidentified; identical to SEQ ID NO: 2533
  REGION 1..137: note = Description of Unknown:uncultivated organism with predicted taxonomy: Collinsella
  REGION 1..137: note = MG14-46 RuvC-III domain

SEQ ID NO: 2544 - protein, 126 aa, unidentified
  REGION 1..126: note = Description of Unknown:uncultivated organism with predicted taxonomy: Collinsella sp.AM13-34
  REGION 1..126: note = MG14-47 RuvC-III domain
NDTRYMSVALAKWLRECLPFARDGHEHVFRVAGGATALMRSVWDIGITGPDGKKNRDDDRHHAVDAAVISCCTPGIVKNVALVNEGHARADVRQRLFRDSLPYPEFKEQVNAWIPCIVPTLTLPNT

SEQ ID NO: 2545 - protein, 137 aa, unidentified
  REGION 1..137: note = Description of Unknown:uncultivated organism with predicted taxonomy: Collinsella
  REGION 1..137: note = MG14-48 RuvC-III domain
TDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRK

SEQ ID NO: 2546 - protein, 126 aa, unidentified
  REGION 1..126: note = Description of Unknown:uncultivated organism with predicted taxonomy: Collinsella sp.AF20-14LB
  REGION 1..126: note = MG14-49 RuvC-III domain
NDTRYMSRQLAMWVRECLPFPDDKRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRT

SEQ ID NO: 2547 - protein, 128 aa, unidentified
  REGION 1..128: note = Description of Unknown:uncultivated organism with predicted taxonomy: Libanicoccusmassiliensis
  REGION 1..128: note = MG14-50 RuvC-III domain
NDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHG

SEQ ID NO: 2548 - protein, 137 aa, unidentified; identical to SEQ ID NO: 2533
  REGION 1..137: note = Description of Unknown:uncultivated organism with predicted taxonomy: Collinsella
  REGION 1..137: note = MG14-51 RuvC-III domain

SEQ ID NO: 2549 - protein, 137 aa, unidentified
  REGION 1..137: note = Description of Unknown:uncultivated organism with predicted taxonomy: Collinsella
  REGION 1..137: note = MG14-52 RuvC-III domain
TDTAYMSREVCAYLADCLLFPDDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRLVPRK

SEQ ID NO: 2550 - protein, 128 aa, unidentified
  REGION 1..128: note = Description of Unknown:uncultivated organism with predicted taxonomy: Olsenella sp.KH3B4
  REGION 1..128: note = MG14-53 RuvC-III domain
NDDRYMSVAVKNYLEDCLLFPEDGRKRHVTAVAGGATGNLRWVWGLNFGSGNVKDRDDDRHHAVDAAIIAACSEGTVQKVAKASSKGREAFKHLRESRLADTQPWPTFADEVIARREFVVPTRMVDHG

SEQ ID NO: 2551 - protein, 128 aa, unidentified
  REGION 1..128: note = Description of Unknown:uncultivated organism with predicted taxonomy: Olsenella sp.KH3B4
  REGION 1..128: note = MG14-54 RuvC-III domain
NDDRYMSVAVKNFLEDRLLFPEDGRKRHVTAVAGGATGNLRWVWGLNFGEGNIKDRTDDRHHAVDAAIIAACSESTVKKVAKASAKAREAFKQLRKSRLADTQPWPTFAAEVAARREFVVPTRMADHG

SEQ ID NO: 2552 - protein, 126 aa, unidentified
  REGION 1..126: note = Description of Unknown:uncultivated organism with predicted taxonomy: Collinsella
  REGION 1..126: note = MG14-55 RuvC-III domain
NDTRYMSKDVAKWLADCLPFPEDGRKHVFCVSGAATAFMRGIWRIGILDDVGKKNREDDRHYAVDAAVIAACTSSIVKGIALISEEHATNRDADRLLDGSLPYPEYRDQVKAWIPCIVPTYSPTRT

SEQ ID NO: 2553 - protein, 137 aa, unidentified
  REGION 1..137: note = Description of Unknown:uncultivated organism with predicted taxonomy: Collinsella
  REGION 1..137: note = MG14-56 RuvC-III domain
TDTAYMSREVCAYLADCLLFPNDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRFVPRK

SEQ ID NO: 2554 - protein, 128 aa, unidentified
  REGION 1..128: note = Description of Unknown:uncultivated organism with predicted taxonomy: Olsenella
  REGION 1..128: note = MG14-57 RuvC-III domain
NDDRYMSVAVKNFLEDRLLFPEDGRKRHVTAVAGGATGSLRWVWGLNFGEGNIKDRTDDRHHAVDAAIIAACSESTVKKVAEASAKGREAFKQLRKSRLADTQPWPSFAAEAAARREFVVPTRMADHG

SEQ ID NO: 2555 - protein, 137 aa, unidentified; identical to SEQ ID NO: 2533
  REGION 1..137: note = Description of Unknown:uncultivated organism with predicted taxonomy: Collinsella
  REGION 1..137: note = MG14-58 RuvC-III domain

SEQ ID NO: 2556 - protein, 137 aa, unidentified; identical to SEQ ID NO: 2535
  REGION 1..137: note = Description of Unknown:uncultivated organism with predicted taxonomy: Collinsella
  REGION 1..137: note = MG14-59 RuvC-III domain

SEQ ID NO: 2557 - protein, 137 aa, unidentified; identical to SEQ ID NO: 2553
  REGION 1..137: note = Description of Unknown:uncultivated organism with predicted taxonomy: Collinsella
  REGION 1..137: note = MG14-60 RuvC-III domain

SEQ ID NO: 2558 - protein, 137 aa, unidentified; identical to SEQ ID NO: 2533
  REGION 1..137: note = Description of Unknown:uncultivated organism with predicted taxonomy: Collinsella
  REGION 1..137: note = MG14-61 RuvC-III domain

SEQ ID NO: 2559 - protein, 137 aa, unidentified
  REGION 1..137: note = Description of Unknown:uncultivated organism with predicted taxonomy: Collinsella
  REGION 1..137: note = MG14-62 RuvC-III domain
TDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALENVMPWETFANEVRAAHDFVVPTRFVPRK

SEQ ID NO: 2560 - protein, 126 aa, unidentified
  REGION 1..126: note = Description of Unknown:uncultivated organism with predicted taxonomy: Collinsella
  REGION 1..126: note = MG14-63 RuvC-III domain
NDTRYMSVALAKWLMECLPFAKDGHEHVFCVAGGATALMRSVWNIGITGPDGKKNRDDDRHHAVDAAVIACCTPGIVKNVALVNEGHARADVRQRLFRDSLPYPEFKEQVDAWIPCIVPTLTLPST

SEQ ID NO: 2561 - protein, 137 aa, unidentified
  REGION 1..137: note = Description of Unknown:uncultivated organism with predicted taxonomy: Collinsella
  REGION 1..137: note = MG14-64 RuvC-III domain
TDTAYMSREVCAYLADCLLFPEDGTKSHVVPTTGRATAWLRRRWGLNFGINGEKDRSDDRHHATDACVIAACSRSLVIKTAKISEQTHWAVTKDLDKDERDHLRMKALENVMPWETFANEVRASHDFVIPTRFVPHK

SEQ ID NO: 2562 - protein, 137 aa, unidentified; identical to SEQ ID NO: 2553
  REGION 1..137: note = Description of Unknown:uncultivated organism with predicted taxonomy: Collinsella
  REGION 1..137: note = MG14-65 RuvC-III domain

SEQ ID NO: 2563 - protein, 137 aa, unidentified
  REGION 1..137: note = Description of Unknown:uncultivated organism with predicted taxonomy: Collinsella
  REGION 1..137: note = MG14-66 RuvC-III domain
TDTAYMSREACAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2564 - protein, 137 aa, unidentified; identical to SEQ ID NO: 2533
  REGION 1..137: note = Description of Unknown:uncultivated organism with predicted taxonomy: Collinsella
  REGION 1..137: note = MG14-67 RuvC-III domain

SEQ ID NO: 2565 - protein, 137 aa, unidentified; identical to SEQ ID NO: 2533
  REGION 1..137: note = Description of Unknown:uncultivated organism with predicted taxonomy: Collinsella
  REGION 1..137: note = MG14-68 RuvC-III domain

SEQ ID NO: 2566 - protein, 128 aa, unidentified
  REGION 1..128: note = Description of Unknown:uncultivated organism with predicted taxonomy: Olsenella
  REGION 1..128: note = MG14-69 RuvC-III domain
NDDRYMSREVKSYLEDTLIFPEDGRVKHVIAVAGGATGSLRHVWGLNFGANNSKDRSDNRHHAIDACVIAACSESTLQAVAKARKLGAETYKRMRKDRLKDTQPWPTFADEVIARREFVIPTHMVSHG

SEQ ID NO: 2567 - protein, 137 aa, unidentified
  REGION 1..137: note = Description of Unknown:uncultivated organism with predicted taxonomy: Collinsellatanakaei
  REGION 1..137: note = MG14-70 RuvC-III domain
TDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRK

SEQ ID NO: 2568 - protein, 137 aa, unidentified
  REGION 1..137: note = Description of Unknown:uncultivated organism with predicted taxonomy: Collinsella
  REGION 1..137: note = MG14-71 RuvC-III domain
TDTAYMSREVCAYLADCLLFPDDGAKAHVVPTTGRATAWLRRRWGLNFGSNGEKDRSDDRHHATDACVISACSRSLVIKTARINQETHWSITRGMNETQRRDAIMKALESVMPWETFANEVRAAHDFVVPTRFVPRK

SEQ ID NO: 2569 - protein, 123 aa, unidentified
  REGION 1..123: note = Description of Unknown:uncultivated organism with predicted taxonomy: Atopobium sp.ICM42b
  REGION 1..123: note = MG14-72 RuvC-III domain
VDTQYMARAISAWLSDSLNFSTEFNQKQHVYAVNGRMTAKLRRKWGLNFGEDDTKDRSDNRHHAIDAAVIAVCSASMVKEFAISYSRLREVRDSVIAEPWEGFADQVREAREWVIPTMYRPNK

SEQ ID NO: 2570 - protein, 137 aa, unidentified; identical to SEQ ID NO: 2533
  REGION 1..137: note = Description of Unknown:uncultivated organism with predicted taxonomy: Collinsella
  REGION 1..137: note = MG14-73 RuvC-III domain

SEQ ID NO: 2571 - protein, 126 aa, unidentified
  REGION 1..126: note = Description of Unknown:uncultivated organism with predicted taxonomy: Collinsella
  REGION 1..126: note = MG14-74 RuvC-III domain
NDTRYMSKDVAKWLADCLPFPEDGRKHIFCVSGAATAFMRGIWRIGILDDAGKKNREDDRHYAVDAAVIAACTSSIVKDIALISEEHATNRDADRLLDGSLPYPEYRDQVKAWIPCIVPTYSPTRT

SEQ ID NO: 2572 - protein, 126 aa, unidentified
  REGION 1..126: note = Description of Unknown:uncultivated organism with predicted taxonomy: Collinsella sp.AM13-34
  REGION 1..126: note = MG14-75 RuvC-III domain
NDTRYMSVALAKWLRECLPFAKDGHEHVFCVAGGATALMRSVWNIGITGPDGKKNREDDRHHAVDAAVIACCTPGIVRNVALVNEGHARADVRQRLFSDSLPYPEFKEQVDAWIPCIVPTLTLPNA

SEQ ID NO: 2573 - protein, 137 aa, unidentified; identical to SEQ ID NO: 2533
  REGION 1..137: note = Description of Unknown:uncultivated organism with predicted taxonomy: Collinsella
  REGION 1..137: note = MG14-76 RuvC-III domain

SEQ ID NO: 2574 - protein, 137 aa, unidentified; identical to SEQ ID NO: 2499
  REGION 1..137: note = Description of Unknown:uncultivated organism with predicted taxonomy: Collinsella
  REGION 1..137: note = MG14-77 RuvC-III domain

SEQ ID NO: 2575 - protein, 137 aa, unidentified
  REGION 1..137: note = Description of Unknown:uncultivated organism with predicted taxonomy: Collinsella
  REGION 1..137: note = MG14-78 RuvC-III domain
TDTAYMSREVCAYLADCLLFPDDGAKAHVVPTTGRATAWLRRRWELNFGSNREKDRSDDRHHATDACVIAACSRSLVIKTARINQETHWSITRGMNETQRRDAIMKALESVMPWETFANEVRAAHDFVVPTRFVPRK

SEQ ID NO: 2576 - protein, 137 aa, unidentified; identical to SEQ ID NO: 2533
  REGION 1..137: note = Description of Unknown:uncultivated organism with predicted taxonomy: Collinsella
  REGION 1..137: note = MG14-79 RuvC-III domain

SEQ ID NO: 2577 - protein, 137 aa, unidentified; identical to SEQ ID NO: 2499
  REGION 1..137: note = Description of Unknown:uncultivated organism with predicted taxonomy:Coriobacteriales
  REGION 1..137: note = MG14-80 RuvC-III domain

SEQ ID NO: 2578 - protein, 137 aa, unidentified
  REGION 1..137: note = Description of Unknown:uncultivated organism with predicted taxonomy: Collinsella
  REGION 1..137: note = MG14-82 RuvC-III domain
TDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRK

SEQ ID NO: 2579 - protein, 137 aa, unidentified; identical to SEQ ID NO: 2507
  REGION 1..137: note = Description of Unknown:uncultivated organism with predicted taxonomy: Collinsella
  REGION 1..137: note = MG14-83 RuvC-III domain

SEQ ID NO: 2580 - protein, 128 aa, unidentified; identical to SEQ ID NO: 2505
  REGION 1..128: note = Description of Unknown:uncultivated organism with predicted taxonomy: Olsenella
  REGION 1..128: note = MG14-84 RuvC-III domain

SEQ ID NO: 2581 - protein, 137 aa, unidentified; identical to SEQ ID NO: 2540
  REGION 1..137: note = Description of Unknown:uncultivated organism with predicted taxonomy: Collinsella
  REGION 1..137: note = MG14-85 RuvC-III domain

SEQ ID NO: 2582 - protein, 137 aa, unidentified; identical to SEQ ID NO: 2538
  REGION 1..137: note = Description of Unknown:uncultivated organism with predicted taxonomy: Collinsella
  REGION 1..137: note = MG14-87 RuvC-III domain

SEQ ID NO: 2583 - protein, 137 aa, unidentified; identical to SEQ ID NO: 2538
  REGION 1..137: note = Description of Unknown:uncultivated organism with predicted taxonomy: Collinsella
  REGION 1..137: note = MG14-88 RuvC-III domain

SEQ ID NO: 2584 - protein, 137 aa, unidentified; identical to SEQ ID NO: 2533
  REGION 1..137: note = Description of Unknown:uncultivated organism with predicted taxonomy: Collinsella
  REGION 1..137: note = MG14-89 RuvC-III domain

SEQ ID NO: 2585 - protein, 137 aa, unidentified
  REGION 1..137: note = Description of Unknown:uncultivated organism with predicted taxonomy: Coriobacteriia
  REGION 1..137: note = MG14-90 RuvC-III domain
TDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENAMPWETFANEVRVAHDFVVPTRFVPRK

SEQ ID NO: 2586 - protein, 137 aa, unidentified; identical to SEQ ID NO: 2567
  REGION 1..137: note = Description of Unknown:uncultivated organism with predicted taxonomy: Collinsellatanakaei
  REGION 1..137: note = MG14-91 RuvC-III domain

SEQ ID NO: 2587 - protein, 137 aa, unidentified; identical to SEQ ID NO: 2541
  REGION 1..137: note = Description of Unknown:uncultivated organism with predicted taxonomy: Collinsella
  REGION 1..137: note = MG14-92 RuvC-III domain

SEQ ID NO: 2588 - protein, 137 aa, unidentified; identical to SEQ ID NO: 2538
  REGION 1..137: note = Description of Unknown:uncultivated organism with predicted taxonomy: Collinsella
  REGION 1..137: note = MG14-93 RuvC-III domain

SEQ ID NO: 2589 - protein, 137 aa, unidentified; identical to SEQ ID NO: 2533
  REGION 1..137: note = Description of Unknown:uncultivated organism with predicted taxonomy: Collinsella
  REGION 1..137: note = MG14-94 RuvC-III domain

SEQ ID NO: 2590 - protein, 126 aa, unidentified
  REGION 1..126: note = Description of Unknown:uncultivated organism with predicted taxonomy: Collinsella
  REGION 1..126: note = MG14-95 RuvC-III domain
NDTRYMSVALAKWLRECLPFTKDGHEHVFCVAGGATALMRSVWDIGITGPDGKKNRDDDRHHAVDAAVIACCTPGIVKNVALVNEGHARADVRQRLFSDSLPYPEFKEQVDAWISCIVPTLTLPNT

SEQ ID NO: 2591 - protein, 137 aa, unidentified
  REGION 1..137: note = Description of Unknown:uncultivated organism with predicted taxonomy: Collinsella
  REGION 1..137: note = MG14-96 RuvC-III domain
TDTAYMSREVCAYLADCLLFPDDGAKAHVVPTTGRATAWLRRRWGLNFGSNGEKDRSDNRHHATDACVIAACSRSLVIKTARINQETHWSITRGMNETQRRDAIMKALESVMPWETFANEVRAAHDFVVPTRFVPRK

SEQ ID NO: 2592 - protein, 137 aa, unidentified; identical to SEQ ID NO: 2533
  REGION 1..137: note = Description of Unknown:uncultivated organism with predicted taxonomy: Collinsella
  REGION 1..137: note = MG14-97 RuvC-III domain

SEQ ID NO: 2593 - protein, 137 aa, unidentified
  REGION 1..137: note = Description of Unknown:uncultivated organism with predicted taxonomy: Collinsella
  REGION 1..137: note = MG14-98 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNEAQRRDAIMKALESVMPWETFANEVRAAHDFVVPTRFVPRK

SEQ ID NO: 2594 - protein, 128 aa, unidentified; identical to SEQ ID NO: 2506
  REGION 1..128: note = Description of Unknown:uncultivated organism with predicted taxonomy: Olsenella
  REGION 1..128: note = MG14-99 RuvC-III domain

SEQ ID NO: 2595 - protein, 137 aa, unidentified; identical to SEQ ID NO: 2533
  REGION 1..137: note = Description of Unknown:uncultivated organism with predicted taxonomy: Collinsella
  REGION 1..137: note = MG14-100 RuvC-III domain

SEQ ID NO: 2596 - protein, 126 aa, unidentified
  REGION 1..126: note = Description of Unknown:uncultivated organism with predicted taxonomy: Eggerthella sp.AM16-19
  REGION 1..126: note = MG14-101 RuvC-III domain
NDTRYMSVALAKWLRECLPFARDGHEHVFCVAGGATALMRSVWNIGITGPDGKKNRDDDRHHAVDAAVIACCTPGIVKNVALVNEGHARADVRQRLFRDSLPYPEFKEQVNAWIPCIVPTLTLPNT

SEQ ID NO: 2597 - protein, 128 aa, unidentified
  REGION 1..128: note = Description of Unknown:uncultivated organism with predicted taxonomy: Olsenella sp.KH3B4
  REGION 1..128: note = MG14-102 RuvC-III domain
NDDRYMSVAVKNFLEDRLLFPEDGRKRHVTAVAGGATGNLRWVWGLNFGEGNIKDRTDDRHHAVDAAIIAACSESTVKKVAKASAKGREAFKQLRKSRLADTQPWPTFAAEVAARREFVVPTRMADHG

SEQ ID NO: 2598 - protein, 137 aa, unidentified; identical to SEQ ID NO: 2538
  REGION 1..137: note = Description of Unknown:uncultivated organism with predicted taxonomy: Collinsella
  REGION 1..137: note = MG14-103 RuvC-III domain

SEQ ID NO: 2599 - protein, 137 aa, unidentified; identical to SEQ ID NO: 2538
  REGION 1..137: note = Description of Unknown:uncultivated organism with predicted taxonomy: Collinsella
  REGION 1..137: note = MG14-104 RuvC-III domain

SEQ ID NO: 2600 - protein, 137 aa, unidentified; identical to SEQ ID NO: 2509
  REGION 1..137: note = Description of Unknown:uncultivated organism with predicted taxonomy: Collinsella
  REGION 1..137: note = MG14-105 RuvC-III domain

SEQ ID NO: 2601 - protein, 137 aa, unidentified; identical to SEQ ID NO: 2549
  REGION 1..137: note = Description of Unknown:uncultivated organism with predicted taxonomy: Collinsella
  REGION 1..137: note = MG14-106 RuvC-III domain

SEQ ID NO: 2602 - protein, 137 aa, unidentified; identical to SEQ ID NO: 2499
  REGION 1..137: note = Description of Unknown:uncultivated organism with predicted taxonomy: Collinsella
  REGION 1..137: note = MG14-107 RuvC-III domain

SEQ ID NO: 2603 - protein, 123 aa, unidentified
  REGION 1..123: note = Description of Unknown:uncultivated organism with predicted taxonomy: Atopobium sp.ICM42b
  REGION 1..123: note = MG14-108 RuvC-III domain
VDTQYMARAISAWLSDSLNFSSEFDQKQHVYAVNGRMTAKLRRKWGLNFGEDDTKDRSDNRHHAIDAAVIAACSASMVKEFAISYSRLREVRDSVIAEPWEGFADQVREAREWIIPTMYRPNK

SEQ ID NO: 2604 - protein, 123 aa, unidentified
  REGION 1..123: note = Description of Unknown:uncultivated organism with predicted taxonomy: Atopobium sp.ICM42b
  REGION 1..123: note = MG14-109 RuvC-III domain
SDTQYMSKAIVAWLSDSLDFPSRYGQKQHVYATNGRMTSKLRKEWGLNFGENGIKDRNDKRHHAVDAAVIAACSASMVKEFATSYSRSHETKNSTIAEPWEGFADQVREAREWVIPTMYRPNK

SEQ ID NO: 2605 - protein, 137 aa, unidentified; identical to SEQ ID NO: 2538
  REGION 1..137: note = Description of Unknown:uncultivated organism with predicted taxonomy: Collinsella
  REGION 1..137: note = MG14-110 RuvC-III domain

SEQ ID NO: 2606 - protein, 126 aa, unidentified
  REGION 1..126: note = Description of Unknown:uncultivated organism
  REGION 1..126: note = MG14-111 RuvC-III domain
NDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRT

SEQ ID NO: 2607 - protein, 137 aa, unidentified
  REGION 1..137: note = Description of Unknown:uncultivated organism with predicted taxonomy: Collinsella
  REGION 1..137: note = MG14-112 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNETQRRGAIMKALESVMPWETFANEVRAAHGFVVPTRFVPRK

SEQ ID NO: 2608 - protein, 137 aa, unidentified; identical to SEQ ID NO: 2533
  REGION 1..137: note = Description of Unknown:uncultivated organism with predicted taxonomy: Collinsella
  REGION 1..137: note = MG14-113 RuvC-III domain

SEQ ID NO: 2609 - protein, 137 aa, unidentified
  REGION 1..137: note = Description of Unknown:uncultivated organism with predicted taxonomy: Collinsella
  REGION 1..137: note = MG14-114 RuvC-III domain
TDTAYMSREVCAYLADCLLFPDDGAKAHVVPTTGRATAWLRRRWGLNFGSNGEKDRSDDRHHATDACVIAACSRSLVIKTARINQEAHWSITRGMNETQRRDAIMKALESVMPWETFANEVRAAHDFVVPTRFVPRK

SEQ ID NO: 2610 - protein, 137 aa, unidentified; identical to SEQ ID NO: 2540
  REGION 1..137: note = Description of Unknown:uncultivated organism with predicted taxonomy: Collinsella
  REGION 1..137: note = MG14-115 RuvC-III domain

SEQ ID NO: 2611 - protein, 137 aa, unidentified
  REGION 1..137: note = Description of Unknown:uncultivated organism with predicted taxonomy: Collinsella
  REGION 1..137: note = MG14-116 RuvC-III domain
TDTAYMSREVCAYLADCLLFPDDGAKAHVVPTTGRATAWLRRRWGLNFGSDGEKDRSDDRHHATDACVIAACSPSLVIKTARINQETHWSITRGMNETQRRDAIMKALESVMPWETFANEVRAAHDFVVPTRFVPRK

SEQ ID NO: 2612 - protein, 137 aa, unidentified; identical to SEQ ID NO: 2545
  REGION 1..137: note = Description of Unknown:uncultivated organism with predicted taxonomy: Collinsella
  REGION 1..137: note = MG14-117 RuvC-III domain

SEQ ID NO: 2613 - protein, 128 aa, unidentified
  REGION 1..128: note = Description of Unknown:uncultivated organism with predicted taxonomy: Olsenella sp.KCTC 15699
  REGION 1..128: note = MG14-118 RuvC-III domain
NDDRYMSVAVKNYLEDCLLFPEDGHKRHVTAVAGGATGNLRWVWGLNFGEGNVKNRADDRHHAVDAAIIAACSESTVKKVAEASAKGREAFKQLRKSRLADTQPWPTFAAEVAARREFVVPTRMADHG

SEQ ID NO: 2614 - protein, 137 aa, unidentified
  REGION 1..137: note = Description of Unknown:uncultivated organism with predicted taxonomy: Collinsella
  REGION 1..137: note = MG14-119 RuvC-III domain
TDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2615 - protein, 137 aa, unidentified; identical to SEQ ID NO: 2567
  REGION 1..137: note = Description of Unknown:uncultivated organism with predicted taxonomy: Collinsellatanakaei
  REGION 1..137: note = MG14-120 RuvC-III domain

SEQ ID NO: 2616 - protein, 137 aa, unidentified
  REGION 1..137: note = Description of Unknown:uncultivated organism with predicted taxonomy: Collinsella
  REGION 1..137: note = MG14-121 RuvC-III domain
TDTAYMSREVCAYLADCLLFPDDGAKAHVVPTTGRATAWLRRRWGLNFGSNGEKDRLDDRHHATDACVIAACSRSLVIKTARINQETHWSITRGMNEAQRRDAIMKALESVMPWETFANEVRAAHDFVVPTRFVPRK

SEQ ID NO: 2617 - protein, 128 aa, unidentified
  REGION 1..128: note = Description of Unknown:uncultivated organism with predicted taxonomy: Olsenella
  REGION 1..128: note = MG14-122 RuvC-III domain
NDDRYMSVAVKNYLEDCLLFPEDGRKRHVTAVAGGATGNLRWVWGLNFGEGNVKDRADDRHHAVDAAIIAACSESTVKKVAEASAKGREAFKQLRKSRLADTQPWPTFAAEVAARREFVVPTRMADHG

SEQ ID NO: 2618 - protein, 137 aa, unidentified; identical to SEQ ID NO: 2533
  REGION 1..137: note = Description of Unknown:uncultivated organism with predicted taxonomy: Olsenellamediterranea
  REGION 1..137: note = MG14-123 RuvC-III domain

SEQ ID NO: 2619 - protein, 137 aa, unidentified; identical to SEQ ID NO: 2533
  REGION 1..137: note = Description of Unknown:uncultivated organism with predicted taxonomy: Collinsella
  REGION 1..137: note = MG14-124 RuvC-III domain

SEQ ID NO: 2620 - protein, 137 aa, unidentified; identical to SEQ ID NO: 2533
  REGION 1..137: note = Description of Unknown:uncultivated organism with predicted taxonomy: Collinsella
  REGION 1..137: note = MG14-125 RuvC-III domain

SEQ ID NO: 2621 - protein, 128 aa, unidentified; identical to SEQ ID NO: 2547
  REGION 1..128: note = Description of Unknown:uncultivated organism with predicted taxonomy: Libanicoccusmassiliensis
  REGION 1..128: note = MG14-126 RuvC-III domain

SEQ ID NO: 2622 - protein, 137 aa, unidentified; identical to SEQ ID NO: 2533
  REGION 1..137: note = Description of Unknown:uncultivated organism with predicted taxonomy: Collinsella
  REGION 1..137: note = MG14-127 RuvC-III domain

SEQ ID NO: 2623 - protein, 137 aa, unidentified; identical to SEQ ID NO: 2538
  REGION 1..137: note = Description of Unknown:uncultivated organism with predicted taxonomy: Collinsella
  REGION 1..137: note = MG14-128 RuvC-III domain

SEQ ID NO: 2624 - protein, 137 aa, unidentified; identical to SEQ ID NO: 2533
  REGION 1..137: note = Description of Unknown:uncultivated organism with predicted taxonomy: Collinsella
  REGION 1..137: note = MG14-129 RuvC-III domain

SEQ ID NO: 2625 - protein, 79 aa, unidentified
  REGION 1..79: note = Description of Unknown:uncultivated organism with predicted taxonomy: Olsenella sp.KH3B4
  REGION 1..79: note = MG14-130 RuvC-III domain
NDDRYMSVAVKNYLEDCLLFPEDGRKRHVTAVAGGATGNLRWVWGLNFGEGNVKDRADDRHHAIDAAIIAACSESTVKK

SEQ ID NO: 2626 - protein, 137 aa, unidentified; identical to SEQ ID NO: 2538
  REGION 1..137: note = Description of Unknown:uncultivated organism with predicted taxonomy: Collinsella
  REGION 1..137: note = MG14-131 RuvC-III domain

SEQ ID NO: 2627 - protein, 137 aa, unidentified; identical to SEQ ID NO: 2533
  REGION 1..137: note = Description of Unknown:uncultivated organism with predicted taxonomy: Collinsella
  REGION 1..137: note = MG14-132 RuvC-III domain

SEQ ID NO: 2628 - protein, 137 aa, unidentified; identical to SEQ ID NO: 2533
  REGION 1..137: note = Description of Unknown:uncultivated organism with predicted taxonomy: Collinsella
  REGION 1..137: note = MG14-133 RuvC-III domain

SEQ ID NO: 2629 - protein, 137 aa, unidentified; identical to SEQ ID NO: 2533
  REGION 1..137: note = Description of Unknown:uncultivated organism with predicted taxonomy: Collinsella
  REGION 1..137: note = MG14-135 RuvC-III domain

SEQ ID NO: 2630 - protein, 137 aa, unidentified
  REGION 1..137: note = Description of Unknown:uncultivated organism with predicted taxonomy: Collinsella
  REGION 1..137: note = MG14-136 RuvC-III domain
TDTAYMSREVCAYLADCLLFPDDGAKAHVVPTTGRATAWLRRRWGLNFGSNREKDCSDDRHHATDACVIAACSRSLVIKTARINQETHWSITRGMNETQRRNAIMKALESVMPWETFANEVRAAHDFVVPTRFVPRK

SEQ ID NO: 2631 - protein, 126 aa, unidentified; identical to SEQ ID NO: 2606
  REGION 1..126: note = Description of Unknown:uncultivated organism with predicted taxonomy: Clostridiales
  REGION 1..126: note = MG14-137 RuvC-III domain

SEQ ID NO: 2632 - protein, 137 aa, unidentified; identical to SEQ ID NO: 2499
  REGION 1..137: note = Description of Unknown:uncultivated organism with predicted taxonomy: Collinsella
  REGION 1..137: note = MG14-138 RuvC-III domain

SEQ ID NO: 2633 - protein, 137 aa, unidentified; identical to SEQ ID NO: 2538
  REGION 1..137: note = Description of Unknown:uncultivated organism with predicted taxonomy: Collinsella
  REGION 1..137: note = MG14-139 RuvC-III domain

SEQ ID NO: 2634 - protein, 137 aa, unidentified; identical to SEQ ID NO: 2533
  REGION 1..137: note = Description of Unknown:uncultivated organism with predicted taxonomy: Collinsella
  REGION 1..137: note = MG14-140 RuvC-III domain

SEQ ID NO: 2635 - protein, 128 aa, unidentified; identical to SEQ ID NO: 2551
  REGION 1..128: note = Description of Unknown:uncultivated organism with predicted taxonomy: Olsenella sp.KH3B4
  REGION 1..128: note = MG14-141 RuvC-III domain

SEQ ID NO: 2636 - protein, 137 aa, unidentified; identical to SEQ ID NO: 2541
  REGION 1..137: note = Description of Unknown:uncultivated organism with predicted taxonomy: Collinsella
  REGION 1..137: note = MG14-142 RuvC-III domain

SEQ ID NO: 2637 - protein, 137 aa, unidentified; identical to SEQ ID NO: 2533
  REGION 1..137: note = Description of Unknown:uncultivated organism with predicted taxonomy: Collinsella
  REGION 1..137: note = MG14-143 RuvC-III domain

SEQ ID NO: 2638 - protein, 126 aa, unidentified
  REGION 1..126: note = Description of Unknown:uncultivated organism with predicted taxonomy: Collinsella
  REGION 1..126: note = MG14-144 RuvC-III domain
NDTRYMSVALAKWLRECLPFARDGHEHVFCVAGGATALMRSVWDIGITGPDGKKNRDDDRHHAVDAAVIACCTPGIVKNVALVNEGHARADVRQRLFRDSLPYPEFKEQVNAWIPCIVPTLTLPNT

SEQ ID NO: 2639 - protein, 128 aa, unidentified; identical to SEQ ID NO: 2505
  REGION 1..128: note = Description of Unknown:uncultivated organism with predicted taxonomy: Olsenella sp.KCTC 15699
  REGION 1..128: note = MG14-145 RuvC-III domain

SEQ ID NO: 2640 - protein, 128 aa, unidentified
  REGION 1..128: note = Description of Unknown:uncultivated organism with predicted taxonomy: Olsenella
  REGION 1..128: note = MG14-146 RuvC-III domain
NDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFAAEVAARREFVVPTHMANHG

SEQ ID NO: 2641 - protein, 128 aa, unidentified; identical to SEQ ID NO: 2532
  REGION 1..128: note = Description of Unknown:uncultivated organism with predicted taxonomy: Olsenella sp.KH3B4
  REGION 1..128: note = MG14-147 RuvC-III domain

SEQ ID NO: 2642 - protein, 137 aa, unidentified; identical to SEQ ID NO: 2533
  REGION 1..137: note = Description of Unknown:uncultivated organism with predicted taxonomy: Olsenellamediterranea
  REGION 1..137: note = MG14-148 RuvC-III domain

SEQ ID NO: 2643 - protein, 137 aa, unidentified; identical to SEQ ID NO: 2538
  REGION 1..137: note = Description of Unknown:uncultivated organism with predicted taxonomy: Collinsella
  REGION 1..137: note = MG14-149 RuvC-III domain

SEQ ID NO: 2644 - protein, 137 aa, unidentified
  REGION 1..137: note = Description of Unknown:uncultivated organism with predicted taxonomy: Collinsella
  REGION 1..137: note = MG14-150 RuvC-III domain
TDTAYMSREVCAYLADCLLFPDDGAKAHVVPTTGRATAWLRRRWGLNFGSNGEKDRSDDRHHATDACVIAACNRSLVIKTARINQETHWSITRGMNETQRRDAIMKALESVMPWETFANEVRAAHDFVVPTRFVPRK

SEQ ID NO: 2645 - protein, 137 aa, unidentified; identical to SEQ ID NO: 2538
  REGION 1..137: note = Description of Unknown:uncultivated organism with predicted taxonomy: Collinsella
  REGION 1..137: note = MG14-151 RuvC-III domain

SEQ ID NO: 2646 - protein, 137 aa, unidentified; identical to SEQ ID NO: 2509
  REGION 1..137: note = Description of Unknown:uncultivated organism with predicted taxonomy: Collinsella
  REGION 1..137: note = MG14-152 RuvC-III domain

SEQ ID NO: 2647 - protein, 137 aa, unidentified; identical to SEQ ID NO: 2509
  REGION 1..137: note = Description of Unknown:uncultivated organism with predicted taxonomy:Coriobacteriales
  REGION 1..137: note = MG14-153 RuvC-III domain

SEQ ID NO: 2648 - protein, 128 aa, unidentified; identical to SEQ ID NO: 2554
  REGION 1..128: note = Description of Unknown:uncultivated organism with predicted taxonomy: Olsenella
  REGION 1..128: note = MG14-154 RuvC-III domain

SEQ ID NO: 2649 - protein, 128 aa, unidentified; identical to SEQ ID NO: 2505
  REGION 1..128: note = Description of Unknown:uncultivated organism with predicted taxonomy: Olsenella
  REGION 1..128: note = MG14-155 RuvC-III domain

SEQ ID NO: 2650 - protein, 128 aa, unidentified; identical to SEQ ID NO: 2547
  REGION 1..128: note = Description of Unknown:uncultivated organism with predicted taxonomy: Libanicoccusmassiliensis
  REGION 1..128: note = MG14-156 RuvC-III domain

SEQ ID NO: 2651 - protein, 137 aa, unidentified; identical to SEQ ID NO: 2540
  REGION 1..137: note = Description of Unknown:uncultivated organism with predicted taxonomy: Collinsella
  REGION 1..137: note = MG14-157 RuvC-III domain

SEQ ID NO: 2652 - protein, 137 aa, unidentified; identical to SEQ ID NO: 2509
  REGION 1..137: note = Description of Unknown:uncultivated organism with predicted taxonomy: Collinsella
  REGION 1..137: note = MG14-158 RuvC-III domain

SEQ ID NO: 2653 - protein, 137 aa, unidentified; identical to SEQ ID NO: 2533
  REGION 1..137: note = Description of Unknown:uncultivated organism with predicted taxonomy: Collinsella
  REGION 1..137: note = MG14-159 RuvC-III domain

SEQ ID NO: 2654 - protein, 137 aa, unidentified; identical to SEQ ID NO: 2553
  REGION 1..137: note = Description of Unknown:uncultivated organism with predicted taxonomy: Collinsella
  REGION 1..137: note = MG14-160 RuvC-III domain

SEQ ID NO: 2655 - protein, 137 aa, unidentified; identical to SEQ ID NO: 2553
  REGION 1..137: note = Description of Unknown:uncultivated organism with predicted taxonomy: Collinsella
  REGION 1..137: note = MG14-161 RuvC-III domain

SEQ ID NO: 2656 - protein, 128 aa, unidentified; identical to SEQ ID NO: 2522
  REGION 1..128: note = Description of Unknown:uncultivated organism with predicted taxonomy: Olsenella
  REGION 1..128: note = MG14-162 RuvC-III domain

SEQ ID NO: 2657 - protein, 137 aa, unidentified; identical to SEQ ID NO: 2553
  REGION 1..137: note = Description of Unknown:uncultivated organism with predicted taxonomy: Collinsella
  REGION 1..137: note = MG14-163 RuvC-III domain

SEQ ID NO: 2658 - protein, 128 aa, unidentified; identical to SEQ ID NO: 2505
  REGION 1..128: note = Description of Unknown:uncultivated organism with predicted taxonomy: Olsenella
  REGION 1..128: note = MG14-164 RuvC-III domain

SEQ ID NO: 2659 - protein, 137 aa, unidentified; identical to SEQ ID NO: 2509
  REGION 1..137: note = Description of Unknown:uncultivated organism with predicted taxonomy: Collinsella
  REGION 1..137: note = MG14-165 RuvC-III domain

SEQ ID NO: 2660 - protein, 137 aa, unidentified; identical to SEQ ID NO: 2533
  REGION 1..137: note = Description of Unknown:uncultivated organism with predicted taxonomy: Collinsella sp.AM17-1
  REGION 1..137: note = MG14-166 RuvC-III domain

SEQ ID NO: 2661 - protein, 137 aa, unidentified; identical to SEQ ID NO: 2538
  REGION 1..137: note = Description of Unknown:uncultivated organism with predicted taxonomy: Collinsella
  REGION 1..137: note = MG14-167 RuvC-III domain

SEQ ID NO: 2662 - protein, 128 aa, unidentified; identical to SEQ ID NO: 2505
  REGION 1..128: note = Description of Unknown:uncultivated organism with predicted taxonomy: Olsenella sp.KH3B4
  REGION 1..128: note = MG14-168 RuvC-III domain

SEQ ID NO: 2663 - protein, 128 aa, unidentified; identical to SEQ ID NO: 2511
  REGION 1..128: note = Description of Unknown:uncultivated organism with predicted taxonomy: Olsenella
  REGION 1..128: note = MG14-169 RuvC-III domain

SEQ ID NO: 2664 - protein, 128 aa, unidentified; identical to SEQ ID NO: 2529
  REGION 1..128: note = Description of Unknown:uncultivated organism with predicted taxonomy: Olsenella sp.KH3B4
  REGION 1..128: note = MG14-170 RuvC-III domain

SEQ ID NO: 2665 - protein, 123 aa, unidentified; identical to SEQ ID NO: 2528
  REGION 1..123: note = Description of Unknown:uncultivated organism with predicted taxonomy: Coriobacteriiabacterium
  REGION 1..123: note = MG14-171 RuvC-III domain

SEQ ID NO: 2666 - protein, 137 aa, unidentified; identical to SEQ ID NO: 2561
  REGION 1..137: note = Description of Unknown:uncultivated organism with predicted taxonomy: Collinsella
  REGION 1..137: note = MG14-172 RuvC-III domain

SEQ ID NO: 2667 - protein, 137 aa, unidentified; identical to SEQ ID NO: 2533
  REGION 1..137: note = Description of Unknown:uncultivated organism with predicted taxonomy: Collinsella
  REGION 1..137: note = MG14-173 RuvC-III domain

SEQ ID NO: 2668 - protein, 137 aa, unidentified
  REGION 1..137: note = Description of Unknown:uncultivated organism with predicted taxonomy: Collinsella
  REGION 1..137: note = MG14-174 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSIIRGMNETQRRDAIMKALESVMPWETFANEVRVAHDFVVPTRFVPRK

SEQ ID NO: 2669 - protein, 137 aa, unidentified; identical to SEQ ID NO: 2535
  REGION 1..137: note = Description of Unknown:uncultivated organism with predicted taxonomy: Collinsella
  REGION 1..137: note = MG14-175 RuvC-III domain

SEQ ID NO: 2670 - protein, 137 aa, unidentified; identical to SEQ ID NO: 2535
  REGION 1..137: note = Description of Unknown:uncultivated organism with predicted taxonomy: Collinsellaaerofaciens
  REGION 1..137: note = MG14-176 RuvC-III domain

SEQ ID NO: 2671 - protein, 137 aa, unidentified; identical to SEQ ID NO: 2533
  REGION 1..137: note = Description of Unknown:uncultivated organism with predicted taxonomy: Collinsella
  REGION 1..137: note = MG14-177 RuvC-III domain

SEQ ID NO: 2672 - protein, 128 aa, unidentified
  REGION 1..128: note = Description of Unknown:uncultivated organism with predicted taxonomy: Olsenella sp.GAM18
  REGION 1..128: note = MG14-178 RuvC-III domain
NDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFATEVAARREFVVPTRMADHG

SEQ ID NO: 2673 - protein, 137 aa, unidentified; identical to SEQ ID NO: 2533
  REGION 1..137: note = Description of Unknown:uncultivated organism with predicted taxonomy: Collinsella
  REGION 1..137: note = MG14-179 RuvC-III domain

SEQ ID NO: 2674 - protein, 137 aa, unidentified; identical to SEQ ID NO: 2545
  REGION 1..137: note = Description of Unknown:uncultivated organism with predicted taxonomy: Collinsella
  REGION 1..137: note = MG14-180 RuvC-III domain

SEQ ID NO: 2675 - protein, 128 aa, unidentified; identical to SEQ ID NO: 2566
  REGION 1..128: note = Description of Unknown:uncultivated organism with predicted taxonomy: Olsenella
  REGION 1..128: note = MG14-181 RuvC-III domain

SEQ ID NO: 2676 - protein, 137 aa, unidentified; identical to SEQ ID NO: 2533
  REGION 1..137: note = Description of Unknown:uncultivated organism with predicted taxonomy: Olsenellamediterranea
  REGION 1..137: note = MG14-182 RuvC-III domain

SEQ ID NO: 2677 - protein, 137 aa, unidentified; identical to SEQ ID NO: 2609
  REGION 1..137: note = Description of Unknown:uncultivated organism with predicted taxonomy: Collinsella
  REGION 1..137: note = MG14-183 RuvC-III domain

SEQ ID NO: 2678 - protein, 128 aa, unidentified; identical to SEQ ID NO: 2617
  REGION 1..128: note = Description of Unknown:uncultivated organism with predicted taxonomy: Olsenella
  REGION 1..128: note = MG14-184 RuvC-III domain

SEQ ID NO: 2679 - protein, 137 aa, unidentified; identical to SEQ ID NO: 2533
  REGION 1..137: note = Description of Unknown:uncultivated organism with predicted taxonomy: Collinsella
  REGION 1..137: note = MG14-185 RuvC-III domain

SEQ ID NO: 2680 - protein, 137 aa, unidentified; identical to SEQ ID NO: 2591
  REGION 1..137: note = Description of Unknown:uncultivated organism with predicted taxonomy: Collinsella
  REGION 1..137: note = MG14-186 RuvC-III domain

SEQ ID NO: 2681 - protein, 137 aa, unidentified; identical to SEQ ID NO: 2585
  REGION 1..137: note = Description of Unknown:uncultivated organism with predicted taxonomy:Coriobacteriales
  REGION 1..137: note = MG14-187 RuvC-III domain

SEQ ID NO: 2682 - protein, 137 aa, unidentified; identical to SEQ ID NO: 2533
  REGION 1..137: note = Description of Unknown:uncultivated organism with predicted taxonomy: Collinsella
  REGION 1..137: note = MG14-188 RuvC-III domain

SEQ ID NO: 2683 - protein, 137 aa, unidentified; identical to SEQ ID NO: 2538
  REGION 1..137: note = Description of Unknown:uncultivated organism with predicted taxonomy: Collinsella
  REGION 1..137: note = MG14-189 RuvC-III domain

SEQ ID NO: 2684 - protein, 137 aa, unidentified; identical to SEQ ID NO: 2533
  REGION 1..137: note = Description of Unknown:uncultivated organism with predicted taxonomy: Collinsella
  REGION 1..137: note = MG14-190 RuvC-III domain

SEQ ID NO: 2685 - protein, 137 aa, unidentified; identical to SEQ ID NO: 2538
  REGION 1..137: note = Description of Unknown:uncultivated organism with predicted taxonomy: Collinsella
  REGION 1..137: note = MG14-191 RuvC-III domain

SEQ ID NO: 2686 - protein, 137 aa, unidentified; identical to SEQ ID NO: 2540
  REGION 1..137: note = Description of Unknown:uncultivated organism with predicted taxonomy: Collinsella
  REGION 1..137: note = MG14-192 RuvC-III domain

SEQ ID NO: 2687 - protein, 137 aa, unidentified; identical to SEQ ID NO: 2538
  REGION 1..137: note = Description of Unknown:uncultivated organism with predicted taxonomy: Collinsella
  REGION 1..137: note = MG14-193 RuvC-III domain

SEQ ID NO: 2688 - protein, 128 aa, unidentified; identical to SEQ ID NO: 2550
  REGION 1..128: note = Description of Unknown:uncultivated organism with predicted taxonomy: Olsenella
  REGION 1..128: note = MG14-194 RuvC-III domain

SEQ ID NO: 2689 - protein, 137 aa, unidentified; identical to SEQ ID NO: 2535
  REGION 1..137: note = Description of Unknown:uncultivated organism with predicted taxonomy: Collinsella
  REGION 1..137: note = MG14-195 RuvC-III domain

SEQ ID NO: 2690 - protein, 126 aa, unidentified; identical to SEQ ID NO: 2560
  REGION 1..126: note = Description of Unknown:uncultivated organism with predicted taxonomy: Collinsella
  REGION 1..126: note = MG14-196 RuvC-III domain

SEQ ID NO: 2691 - protein, 137 aa, unidentified; identical to SEQ ID NO: 2533
  REGION 1..137: note = Description of Unknown:uncultivated organism with predicted taxonomy: Collinsella
  REGION 1..137: note = MG14-197 RuvC-III domain

SEQ ID NO: 2692 - protein, 137 aa, unidentified; identical to SEQ ID NO: 2545
  REGION 1..137: note = Description of Unknown:uncultivated organism with predicted taxonomy: Collinsella
  REGION 1..137: note = MG14-198 RuvC-III domain

SEQ ID NO: 2693 - protein, 137 aa, unidentified; identical to SEQ ID NO: 2568
  REGION 1..137: note = Description of Unknown:uncultivated organism with predicted taxonomy: Collinsella
  REGION 1..137: note = MG14-199 RuvC-III domain

SEQ ID NO: 2694 - protein, 137 aa, unidentified; identical to SEQ ID NO: 2538
  REGION 1..137: note = Description of Unknown:uncultivated organism with predicted taxonomy: Collinsella
  REGION 1..137: note = MG14-200 RuvC-III domain

SEQ ID NO: 2695 - protein, 137 aa, unidentified; identical to SEQ ID NO: 2533
  REGION 1..137: note = Description of Unknown:uncultivated organism with predicted taxonomy: Collinsella
  REGION 1..137: note = MG14-201 RuvC-III domain

SEQ ID NO: 2696 - protein, 137 aa, unidentified; identical to SEQ ID NO: 2533
  REGION 1..137: note = Description of Unknown:uncultivated organism with predicted taxonomy: Collinsella
  REGION 1..137: note = MG14-202 RuvC-III domain

SEQ ID NO: 2697 - protein, 137 aa, unidentified; identical to SEQ ID NO: 2533
  REGION 1..137: note = Description of Unknown:uncultivated organism with predicted taxonomy: Collinsella
  REGION 1..137: note = MG14-203 RuvC-III domain

SEQ ID NO: 2698 - protein, 137 aa, unidentified; identical to SEQ ID NO: 2538
  REGION 1..137: note = Description of Unknown:uncultivated organism with predicted taxonomy: Collinsella
  REGION 1..137: note = MG14-204 RuvC-III domain

SEQ ID NO: 2699 - protein, 137 aa, unidentified; identical to SEQ ID NO: 2533
  REGION 1..137: note = Description of Unknown:uncultivated organism with predicted taxonomy: Olsenellamediterranea
  REGION 1..137: note = MG14-205 RuvC-III domain

SEQ ID NO: 2700 - protein, 73 aa, unidentified
  REGION 1..73: note = Description of Unknown:uncultivated organism with predicted taxonomy: Collinsella
  REGION 1..73: note = MG14-206 RuvC-III domain
TDTAYMSREVCAYLADCLLFPDDGAKAHVVPTTGRATAWLRRRWGLNFGSNGEKDRSDDRHHACHRCLCDCSM

SEQ ID NO: 2701 - protein, 137 aa, unidentified; identical to SEQ ID NO: 2630
  REGION 1..137: note = Description of Unknown:uncultivated organism with predicted taxonomy: Collinsella
  REGION 1..137: note = MG14-207 RuvC-III domain

SEQ ID NO: 2702 - protein, 128 aa, unidentified; identical to SEQ ID NO: 2597
  REGION 1..128: note = Description of Unknown:uncultivated organism with predicted taxonomy: Olsenella
  REGION 1..128: note = MG14-208 RuvC-III domain

SEQ ID NO: 2703 - protein, 137 aa, unidentified; identical to SEQ ID NO: 2559
  REGION 1..137: note = Description of Unknown:uncultivated organism with predicted taxonomy: Collinsella
  REGION 1..137: note = MG14-209 RuvC-III domain

SEQ ID NO: 2704 - protein, 137 aa, unidentified; identical to SEQ ID NO: 2575
  REGION 1..137: note = Description of Unknown:uncultivated organism with predicted taxonomy: Collinsella
  REGION 1..137: note = MG14-210 RuvC-III domain

SEQ ID NO: 2705 - protein, 137 aa, unidentified; identical to SEQ ID NO: 2533
  REGION 1..137: note = Description of Unknown:uncultivated organism with predicted taxonomy: Collinsella
  REGION 1..137: note = MG14-211 RuvC-III domain

SEQ ID NO: 2706 - protein, 126 aa, unidentified; identical to SEQ ID NO: 2590
  REGION 1..126: note = Description of Unknown:uncultivated organism with predicted taxonomy: Collinsella
  REGION 1..126: note = MG14-212 RuvC-III domain

SEQ ID NO: 2707 - protein, 137 aa, unidentified; identical to SEQ ID NO: 2533
  REGION 1..137: note = Description of Unknown:uncultivated organism with predicted taxonomy: Collinsella
  REGION 1..137: note = MG14-213 RuvC-III domain

SEQ ID NO: 2708 - protein, 137 aa, unidentified; identical to SEQ ID NO: 2533
  REGION 1..137: note = Description of Unknown:uncultivated organism with predicted taxonomy:Coriobacteriales
  REGION 1..137: note = MG14-214 RuvC-III domain

SEQ ID NO: 2709 - protein, 115 aa, unidentified
  REGION 1..115: note = Description of Unknown:uncultivated organism with predicted taxonomy: Olsenella
  REGION 1..115: note = MG14-215 RuvC-III domain
NDTRYMSRATMAFLADTLEYPDDGRKRHVIAVAGSATSALRHVWGLNFGEGNVKDRSDDRHHAVDACVIAACSESTLKKVARARSRGYRSFKKTQESRLSDTQPWPTFADDVIAM

SEQ ID NO: 2710 - protein, 137 aa, unidentified; identical to SEQ ID NO: 2533
  REGION 1..137: note = Description of Unknown:uncultivated organism with predicted taxonomy: Collinsella
  REGION 1..137: note = MG14-216 RuvC-III domain

SEQ ID NO: 2711 - protein, 137 aa, unidentified; identical to SEQ ID NO: 2533
  REGION 1..137: note = Description of Unknown:uncultivated organism with predicted taxonomy: Collinsella
  REGION 1..137: note = MG14-217 RuvC-III domain

SEQ ID NO: 2712 - protein, 137 aa, unidentified
  REGION 1..137: note = Description of Unknown:uncultivated organism with predicted taxonomy: Olsenellamediterranea
  REGION 1..137: note = MG14-218 RuvC-III domain
TDTAYMSREVCAYLADCLLFPDDGAKAHVVPTTGRATAWLRRRWGLSFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2713 - protein, 137 aa, unidentified; identical to SEQ ID NO: 2538
  REGION 1..137: note = Description of Unknown:uncultivated organism with predicted taxonomy: Collinsella
  REGION 1..137: note = MG14-219 RuvC-III domain

SEQ ID NO: 2714 - protein, 137 aa, unidentified; identical to SEQ ID NO: 2538
  REGION 1..137: note = Description of Unknown:uncultivated organism with predicted taxonomy: Collinsella
  REGION 1..137: note = MG14-220 RuvC-III domain

SEQ ID NO: 2715 - protein, 137 aa, unidentified; identical to SEQ ID NO: 2540
  REGION 1..137: note = Description of Unknown:uncultivated organism with predicted taxonomy: Collinsella
  REGION 1..137: note = MG14-221 RuvC-III domain

SEQ ID NO: 2716 - protein, 137 aa, unidentified; identical to SEQ ID NO: 2538
  REGION 1..137: note = Description of Unknown:uncultivated organism with predicted taxonomy: Collinsella
  REGION 1..137: note = MG14-222 RuvC-III domain

SEQ ID NO: 2717 - protein, 126 aa, unidentified
  REGION 1..126: note = Description of Unknown:uncultivated organism with predicted taxonomy: Collinsella sp.AM13-34
  REGION 1..126: note = MG14-223 RuvC-III domain
NDTRYMSVALAKWLRECLPFTKDGHEHVFCVAGGATALMRSVWDIGITGPDGKKNRDDDRHHAVDAAVIACCTPGIVRNVALVNEGHARADVRQRLFSDSLPYPEFKEQVDAWIPCIVPTLTLPNT

SEQ ID NO: 2718 - protein, 137 aa, unidentified; identical to SEQ ID NO: 2563
  REGION 1..137: note = Description of Unknown:uncultivated organism with predicted taxonomy: Collinsella
  REGION 1..137: note = MG14-224 RuvC-III domain

SEQ ID NO: 2719 - protein, 137 aa, unidentified; identical to SEQ ID NO: 2499
  REGION 1..137: note = Description of Unknown:uncultivated organism with predicted taxonomy: Collinsella
  REGION 1..137: note = MG14-225 RuvC-III domain

SEQ ID NO: 2720 - protein, 137 aa, unidentified; identical to SEQ ID NO: 2499
  REGION 1..137: note = Description of Unknown:uncultivated organism with predicted taxonomy: Collinsella
  REGION 1..137: note = MG14-226 RuvC-III domain

SEQ ID NO: 2721 - protein, 137 aa, unidentified; identical to SEQ ID NO: 2533
  REGION 1..137: note = Description of Unknown:uncultivated organism with predicted taxonomy: Collinsella
  REGION 1..137: note = MG14-227 RuvC-III domain

SEQ ID NO: 2722 - protein, 137 aa, unidentified; identical to SEQ ID NO: 2567
  REGION 1..137: note = Description of Unknown:uncultivated organism with predicted taxonomy: Olsenella
  REGION 1..137: note = MG14-228 RuvC-III domain

SEQ ID NO: 2723 - protein, 137 aa, unidentified; identical to SEQ ID NO: 2614
  REGION 1..137: note = Description of Unknown:uncultivated organism with predicted taxonomy: Olsenella
  REGION 1..137: note = MG14-229 RuvC-III domain

SEQ ID NO: 2724 - protein, 137 aa, unidentified; identical to SEQ ID NO: 2533
  REGION 1..137: note = Description of Unknown:uncultivated organism with predicted taxonomy: Collinsella
  REGION 1..137: note = MG14-230 RuvC-III domain

SEQ ID NO: 2725 - protein, 137 aa, unidentified; identical to SEQ ID NO: 2607
  REGION 1..137: note = Description of Unknown:uncultivated organism with predicted taxonomy: Collinsella
  REGION 1..137: note = MG14-231 RuvC-III domain

SEQ ID NO: 2726 - protein, 137 aa, unidentified; identical to SEQ ID NO: 2538
  REGION 1..137: note = Description of Unknown:uncultivated organism with predicted taxonomy: Collinsella
  REGION 1..137: note = MG14-232 RuvC-III domain

SEQ ID NO: 2727 - protein, 137 aa, unidentified; identical to SEQ ID NO: 2533
  REGION 1..137: note = Description of Unknown:uncultivated organism with predicted taxonomy: Collinsella
  REGION 1..137: note = MG14-233 RuvC-III domain

SEQ ID NO: 2728 - protein, 137 aa, unidentified; identical to SEQ ID NO: 2541
  REGION 1..137: note = Description of Unknown:uncultivated organism with predicted taxonomy: Collinsella
  REGION 1..137: note = MG14-234 RuvC-III domain

SEQ ID NO: 2729 - protein, 137 aa, unidentified; identical to SEQ ID NO: 2611
  REGION 1..137: note = Description of Unknown:uncultivated organism with predicted taxonomy: Collinsella
  REGION 1..137: note = MG14-235 RuvC-III domain

SEQ ID NO: 2730 - protein, 137 aa, unidentified; identical to SEQ ID NO: 2533
  REGION 1..137: note = Description of Unknown:uncultivated organism with predicted taxonomy: Collinsella
  REGION 1..137: note = MG14-236 RuvC-III domain

SEQ ID NO: 2731 - protein, 137 aa, unidentified; identical to SEQ ID NO: 2533
  REGION 1..137: note = Description of Unknown:uncultivated organism with predicted taxonomy: Collinsella
  REGION 1..137: note = MG14-237 RuvC-III domain

SEQ ID NO: 2732 - protein, 123 aa, unidentified; identical to SEQ ID NO: 2603
  REGION 1..123: note = Description of Unknown:uncultivated organism with predicted taxonomy: Atopobium sp.ICM42b
  REGION 1..123: note = MG14-238 RuvC-III domain

SEQ ID NO: 2733 - protein, 137 aa, unidentified; identical to SEQ ID NO: 2578
  REGION 1..137: note = Description of Unknown:uncultivated organism with predicted taxonomy: Collinsella
  REGION 1..137: note = MG14-239 RuvC-III domain

SEQ ID NO: 2734 - protein, 137 aa, unidentified; identical to SEQ ID NO: 2593
  REGION 1..137: note = Description of Unknown:uncultivated organism with predicted taxonomy: Collinsella
  REGION 1..137: note = MG14-240 RuvC-III domain

SEQ ID NO: 2735 - protein, 137 aa, unidentified; identical to SEQ ID NO: 2616
  REGION 1..137: note = Description of Unknown:uncultivated organism with predicted taxonomy: Collinsella
  REGION 1..137: note = MG14-241 RuvC-III domain

SEQ ID NO: 2736 - protein, 137 aa, unidentified; identical to SEQ ID NO: 2499
  REGION 1..137: note = Description of Unknown:uncultivated organism with predicted taxonomy: Collinsella
  REGION 1..137: note = MG14-242 RuvC-III domain

SEQ ID NO: 2737 - protein, 137 aa, unidentified; identical to SEQ ID NO: 2541
  REGION 1..137: note = Description of Unknown:uncultivated organism with predicted taxonomy: Collinsella
  REGION 1..137: note = MG14-243 RuvC-III domain

SEQ ID NO: 2738 - protein, 129 aa, unidentified
  REGION 1..129: note = Description of Unknown:uncultivated organism
  REGION 1..129: note = MG14-244 RuvC-III domain
NDTRYMSVAVKNYLEDCLLFPEDGRKLHVTAVSGGATASLRRVWGLNSNGSDDEKTNSNTMRNSIDAAVIAACSVKTVQAVAKTRSLGRETFRHMRRSRLADTQPWETFADDVIVKCKTVIPTRMAEHG

SEQ ID NO: 2739 - protein, 128 aa, unidentified
  REGION 1..128: note = Description of Unknown:uncultivated organism with predicted taxonomy: Olsenella
  REGION 1..128: note = MG14-245 RuvC-III domain
NDDRYMSVAVKNYLEDCLLFPNDGRKKHVTAVAGGATGNLRWVWGLNFGQGNTKDRDDDRHHAVDAAIIAACSESTVKKVAEASSKGRETFKHLRKSRLSDTQPWPTFAEEVAARRAFVVPTRMVNHG

SEQ ID NO: 2740 - protein, 128 aa, unidentified
  REGION 1..128: note = Description of Unknown:uncultivated organism with predicted taxonomy:Coriobacteriales
  REGION 1..128: note = MG14-246 RuvC-III domain
NDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHG

SEQ ID NO: 2741 - protein, 128 aa, unidentified; identical to SEQ ID NO: 2740
  REGION 1..128: note = Description of Unknown:uncultivated organism with predicted taxonomy:Coriobacteriales
  REGION 1..128: note = MG14-247 RuvC-III domain

SEQ ID NO: 2742 - protein, 128 aa, unidentified; identical to SEQ ID NO: 2740
  REGION 1..128: note = Description of Unknown:uncultivated organism
  REGION 1..128: note = MG14-248 RuvC-III domain

SEQ ID NO: 2743 - protein, 128 aa, unidentified; identical to SEQ ID NO: 2740
  REGION 1..128: note = Description of Unknown:uncultivated organism with predicted taxonomy: Olsenella
  REGION 1..128: note = MG14-249 RuvC-III domain

SEQ ID NO: 2744 - protein, 128 aa, unidentified
  REGION 1..128: note = Description of Unknown:uncultivated organism with predicted taxonomy: Olsenella
  REGION 1..128: note = MG14-250 RuvC-III domain
NDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHG

SEQ ID NO: 2745 - protein, 129 aa, unidentified
  REGION 1..129: note = Description of Unknown:uncultivated organism
  REGION 1..129: note = MG14-251 RuvC-III domain
NDTRYMSVAIKNYLEDCLLFPEDGRKLHVTAVSGGATASLRRVWGLNTKGSDDEKTNSDTMRNAIDAAVIAACSVKTVQAVAKTRSLGRETFRHMRRSRLADTQPWETFADDVLAKCETVIPTRMAEHG

SEQ ID NO: 2746 - protein, 128 aa, unidentified
  REGION 1..128: note = Description of Unknown:uncultivated organism with predicted taxonomy: Olsenellaumbonata
  REGION 1..128: note = MG14-252 RuvC-III domain
NDDRYMSRAVKSYLEDTLIFPEDGRKKHVTAVSGGATGSLRHVWGLNFGDGNTKDRSDNRHHAVDACVIAACSEATVQAVAKARKLGAEAYKHIREDRLKDTQPWPTFADEVVARREFVIPTRMVSHG

SEQ ID NO: 2747 - protein, 123 aa, unidentified
  REGION 1..123: note = Description of Unknown:uncultivated organism with predicted taxonomy: Atopobium sp.ICM42b
  REGION 1..123: note = MG14-253 RuvC-III domain
NDNRYLSRAVMNWLAETLAFGDMDRRHVYAVTGAGTAILRKSWALNFGPNGLKDRNYDRHHAIDAAVIAACSVSTIQAIATAHAHERRLSESRMVSTQPWPSFAIELTQRIERVVPTHQVQHK

SEQ ID NO: 2748 - protein, 128 aa, unidentified; identical to SEQ ID NO: 2744
  REGION 1..128: note = Description of Unknown:uncultivated organism with predicted taxonomy: Olsenella sp.KH3B4
  REGION 1..128: note = MG14-254 RuvC-III domain

SEQ ID NO: 2749 - protein, 128 aa, unidentified; identical to SEQ ID NO: 2746
  REGION 1..128: note = Description of Unknown:uncultivated organism with predicted taxonomy: Olsenella
  REGION 1..128: note = MG14-255 RuvC-III domain

SEQ ID NO: 2750 - protein, 93 aa, unidentified
  REGION 1..93: note = Description of Unknown:uncultivated organism with predicted taxonomy: Olsenella
  REGION 1..93: note = MG14-256 RuvC-III domain
NDNRYLSRSVMNWLADTLAFDNLGHRHVYAVTGAGTAILRRHWALNFGSNGLKDRNDDRHHAIDAAVIAACSVSTIQSIATAHARGYRSSESR

SEQ ID NO: 2751 - protein, 153 aa, unidentified
  REGION 1..153: note = Description of Unknown:uncultivated organism with predicted taxonomy: Megasphaera
  REGION 1..153: note = MG15-1 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRK

SEQ ID NO: 2752 - protein, 169 aa, unidentified
  REGION 1..169: note = Description of Unknown:uncultivated organism with predicted taxonomy: Selenomonas sp.AE3005
  REGION 1..169: note = MG15-3 RuvC-III domain
TDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRK

SEQ ID NO: 2753 - protein, 169 aa, unidentified; identical to SEQ ID NO: 2752
  REGION 1..169: note = Description of Unknown:uncultivated organism with predicted taxonomy: Selenomonas sp.AE3005
  REGION 1..169: note = MG15-4 RuvC-III domain

SEQ ID NO: 2754 - protein, 158 aa, unidentified
  REGION 1..158: note = Description of Unknown:uncultivated organism with predicted taxonomy: Veillonellales
  REGION 1..158: note = MG15-6 RuvC-III domain
QDTQYISRFLYNYLRNTLKLAPGYTDRKRRIIPVNGAVTGYIRKRLDIRKIRENGDLHHAVDAVVIAVTTQGMIQKVTRYSQIRENPKLIDKKTGEVLTAKEFHNKDNFPEPWPRFRQELEVRVSEDPEEAIRRLRLPAYENVGEIKKPFVSRMPRRK

SEQ ID NO: 2755 - protein, 153 aa, unidentified
  REGION 1..153: note = Description of Unknown:uncultivated organism with predicted taxonomy: Megasphaerastantonii
  REGION 1..153: note = MG15-7 RuvC-III domain
QDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2756 - protein, 164 aa, unidentified
  REGION 1..164: note = Description of Unknown:uncultivated organism with predicted taxonomy: Dialister
  REGION 1..164: note = MG15-8 RuvC-III domain
QDTQYISRFLYNYLRNTLELAPGYTDRKRRIIPVNGAVTGYIRKRLDIRKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENAGEIKKPFVSRMPRRK

SEQ ID NO: 2757 - protein, 153 aa, unidentified; identical to SEQ ID NO: 2755
  REGION 1..153: note = Description of Unknown:uncultivated organism with predicted taxonomy: Dialisterinvisus
  REGION 1..153: note = MG15-9 RuvC-III domain

SEQ ID NO: 2758 - protein, 153 aa, unidentified
  REGION 1..153: note = Description of Unknown:uncultivated organism with predicted taxonomy: Dialister
  REGION 1..153: note = MG15-10 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRK

SEQ ID NO: 2759 - protein, 153 aa, unidentified; identical to SEQ ID NO: 2758
  REGION 1..153: note = Description of Unknown:uncultivated organism with predicted taxonomy: Dialister
  REGION 1..153: note = MG15-11 RuvC-III domain

SEQ ID NO: 2760 - protein, 167 aa, unidentified
  REGION 1..167: note = Description of Unknown:uncultivated organism with predicted taxonomy: Megasphaeramicronuciformis
  REGION 1..167: note = MG15-12 RuvC-III domain
QDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHK

SEQ ID NO: 2761 - protein, 153 aa, unidentified; identical to SEQ ID NO: 2755
  REGION 1..153: note = Description of Unknown:uncultivated organism with predicted taxonomy: Megasphaera sp.AM44-1BH
  REGION 1..153: note = MG15-13 RuvC-III domain

SEQ ID NO: 2762 - protein, 153 aa, unidentified
  REGION 1..153: note = Description of Unknown:uncultivated organism with predicted taxonomy: Dialister
  REGION 1..153: note = MG15-14 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2763 - protein, 167 aa, unidentified
  REGION 1..167: note = Description of Unknown:uncultivated organism with predicted taxonomy: Megasphaeramicronuciformis
  REGION 1..167: note = MG15-15 RuvC-III domain
QDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHK

SEQ ID NO: 2764 - protein, 165 aa, unidentified
  REGION 1..165: note = Description of Unknown:uncultivated organism with predicted taxonomy: Megasphaerastantonii
  REGION 1..165: note = MG15-16 RuvC-III domain
QDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRK

SEQ ID NO: 2765 - protein, 153 aa, unidentified; identical to SEQ ID NO: 2755
  REGION 1..153: note = Description of Unknown:uncultivated organism with predicted taxonomy: Dialister
  REGION 1..153: note = MG15-17 RuvC-III domain

SEQ ID NO: 2766 - protein, 167 aa, unidentified
  REGION 1..167: note = Description of Unknown:uncultivated organism with predicted taxonomy: Megasphaeramicronuciformis
  REGION 1..167: note = MG15-18 RuvC-III domain
QDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHK

SEQ ID NO: 2767 - protein, 167 aa, unidentified
  REGION 1..167: note = Description of Unknown:uncultivated organism with predicted taxonomy: Megasphaeramicronuciformis
  REGION 1..167: note = MG15-19 RuvC-III domain
QDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHK

SEQ ID NO: 2768 - protein, 153 aa, unidentified; identical to SEQ ID NO: 2751
  REGION 1..153: note = Description of Unknown:uncultivated organism with predicted taxonomy: Dialister
  REGION 1..153: note = MG15-20 RuvC-III domain

SEQ ID NO: 2769 - protein, 153 aa, unidentified; identical to SEQ ID NO: 2755
  REGION 1..153: note = Description of Unknown:uncultivated organism with predicted taxonomy: Dialister
  REGION 1..153: note = MG15-21 RuvC-III domain

SEQ ID NO: 2770 - protein, 153 aa, unidentified; identical to SEQ ID NO: 2751
  REGION 1..153: note = Description of Unknown:uncultivated organism with predicted taxonomy: Dialister
  REGION 1..153: note = MG15-22 RuvC-III domain

SEQ ID NO: 2771 - protein, 153 aa, unidentified; identical to SEQ ID NO: 2758
  REGION 1..153: note = Description of Unknown:uncultivated organism with predicted taxonomy: Dialister
  REGION 1..153: note = MG15-23 RuvC-III domain

SEQ ID NO: 2772 - protein, 153 aa, unidentified
  REGION 1..153: note = Description of Unknown:uncultivated organism with predicted taxonomy: Dialisterinvisus
  REGION 1..153: note = MG15-24 RuvC-III domain
QDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRK

SEQ ID NO: 2773 - protein, 153 aa, unidentified; identical to SEQ ID NO: 2772
  REGION 1..153: note = Description of Unknown:uncultivated organism with predicted taxonomy: Dialister
  REGION 1..153: note = MG15-25 RuvC-III domain

SEQ ID NO: 2774 - protein, 153 aa, unidentified; identical to SEQ ID NO: 2751
  REGION 1..153: note = Description of Unknown:uncultivated organism with predicted taxonomy: Dialister
  REGION 1..153: note = MG15-26 RuvC-III domain

SEQ ID NO: 2775 - protein, 153 aa, unidentified
  REGION 1..153: note = Description of Unknown:uncultivated organism with predicted taxonomy: Dialister
  REGION 1..153: note = MG15-27 RuvC-III domain
QDTQYISKYLYNYLRHHLVLAKGYTERKRRIIPVNGAVTAYFRKRLGINKIRGNGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRK

SEQ ID NO: 2776 - protein, 153 aa, unidentified; identical to SEQ ID NO: 2751
  REGION 1..153: note = Description of Unknown:uncultivated organism with predicted taxonomy: Dialister
  REGION 1..153: note = MG15-28 RuvC-III domain

SEQ ID NO: 2777 - protein, 119 aa, unidentified
  REGION 1..119: note = Description of Unknown:uncultivated organism with predicted taxonomy: Dialisterinvisus
  REGION 1..119: note = MG15-29 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRY

SEQ ID NO: 2778 - protein, 153 aa, unidentified; identical to SEQ ID NO: 2755
  REGION 1..153: note = Description of Unknown:uncultivated organism with predicted taxonomy: Megasphaera sp.AM44-1BH
  REGION 1..153: note = MG15-30 RuvC-III domain

SEQ ID NO: 2779 - protein, 153 aa, unidentified
  REGION 1..153: note = Description of Unknown:uncultivated organism with predicted taxonomy: Dialister
  REGION 1..153: note = MG15-31 RuvC-III domain
QDTQYISKYLYNYLRHHLVLAKGYTERKRRIIPVNGAVTAYFRKRLGINKIRENGDLHHAVDAVIIACATQGIINKVSRYSKSRELWDYEVDMETGEVLQKKNKNTKDVFPEPWLNFRYELEQKVRVRPLNIPETADITEMEEPFVSHMPNRK

SEQ ID NO: 2780 - protein, 153 aa, unidentified; identical to SEQ ID NO: 2751
  REGION 1..153: note = Description of Unknown:uncultivated organism with predicted taxonomy: Veillonellales
  REGION 1..153: note = MG15-32 RuvC-III domain

SEQ ID NO: 2781 - protein, 153 aa, unidentified
  REGION 1..153: note = Description of Unknown:uncultivated organism with predicted taxonomy: Dialister
  REGION 1..153: note = MG15-33 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRK

SEQ ID NO: 2782 - protein, 153 aa, unidentified; identical to SEQ ID NO: 2772
  REGION 1..153: note = Description of Unknown:uncultivated organism with predicted taxonomy: Megasphaera
  REGION 1..153: note = MG15-34 RuvC-III domain

SEQ ID NO: 2783 - protein, 165 aa, unidentified; identical to SEQ ID NO: 2764
  REGION 1..165: note = Description of Unknown:uncultivated organism with predicted taxonomy: Megasphaera
  REGION 1..165: note = MG15-35 RuvC-III domain

SEQ ID NO: 2784 - protein, 153 aa, unidentified; identical to SEQ ID NO: 2772
  REGION 1..153: note = Description of Unknown:uncultivated organism with predicted taxonomy: Dialister
  REGION 1..153: note = MG15-36 RuvC-III domain

SEQ ID NO: 2785 - protein, 153 aa, unidentified; identical to SEQ ID NO: 2772
  REGION 1..153: note = Description of Unknown:uncultivated organism with predicted taxonomy: Dialister
  REGION 1..153: note = MG15-37 RuvC-III domain

SEQ ID NO: 2786 - protein, 170 aa, unidentified
  REGION 1..170: note = Description of Unknown:uncultivated organism with predicted taxonomy: Selenomonasbovis
  REGION 1..170: note = MG15-38 RuvC-III domain
NDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHK

SEQ ID NO: 2787 - protein, 153 aa, unidentified; identical to SEQ ID NO: 2751
  REGION 1..153: note = Description of Unknown:uncultivated organism with predicted taxonomy: Dialister
  REGION 1..153: note = MG15-39 RuvC-III domain

SEQ ID NO: 2788 - protein, 153 aa, unidentified; identical to SEQ ID NO: 2751
  REGION 1..153: note = Description of Unknown:uncultivated organism with predicted taxonomy: Dialister
  REGION 1..153: note = MG15-40 RuvC-III domain

SEQ ID NO: 2789 - protein, 165 aa, unidentified
  REGION 1..165: note = Description of Unknown:uncultivated organism with predicted taxonomy: Megasphaera sp.AM44-1BH
  REGION 1..165: note = MG15-41 RuvC-III domain
QDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDPFPEPWPHFRQELEARVGKQPQEAIAALHLPTYKNVESIYTPFVSRMPNRK

SEQ ID NO: 2790 - protein, 167 aa, unidentified
  REGION 1..167: note = Description of Unknown:uncultivated organism with predicted taxonomy: Veillonellales
  REGION 1..167: note = MG15-42 RuvC-III domain
QDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRK

SEQ ID NO: 2791 - protein, 153 aa, unidentified; identical to SEQ ID NO: 2758
  REGION 1..153: note = Description of Unknown:uncultivated organism with predicted taxonomy: Veillonellales
  REGION 1..153: note = MG15-43 RuvC-III domain

SEQ ID NO: 2792 - protein, 167 aa, unidentified; identical to SEQ ID NO: 2790
  REGION 1..167: note = Description of Unknown:uncultivated organism with predicted taxonomy: Veillonellales
  REGION 1..167: note = MG15-44 RuvC-III domain

SEQ ID NO: 2793 - protein, 170 aa, unidentified; identical to SEQ ID NO: 2786
  REGION 1..170: note = Description of Unknown:uncultivated organism with predicted taxonomy: Selenomonasbovis
  REGION 1..170: note = MG15-45 RuvC-III domain

SEQ ID NO: 2794 - protein, 153 aa, unidentified
  REGION 1..153: note = Description of Unknown:uncultivated organism with predicted taxonomy: Dialister
  REGION 1..153: note = MG15-46 RuvC-III domain
QDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2795 - protein, 158 aa, unidentified
  REGION 1..158: note = Description of Unknown:uncultivated organism with predicted taxonomy: Dialister
  REGION 1..158: note = MG15-47 RuvC-III domain
QDTQYISRFLYNYLRNTLELTPGYTDRKRRIIPVNGAVTGYIRKRLGIRKIRENGDLHHAVDAVVIAVTTQGMIQKVTRYSQIRENPKLIDKKTGEVLTAKEFHNKDNFPEPWPRFRQELEARVSEDPEEAIRRLRLPAYENVGEIKKPFISRMPRRK

SEQ ID NO: 2796 - protein, 170 aa, unidentified; identical to SEQ ID NO: 2786
  REGION 1..170: note = Description of Unknown:uncultivated organism with predicted taxonomy: Selenomonasbovis
  REGION 1..170: note = MG15-48 RuvC-III domain

SEQ ID NO: 2797 - protein, 153 aa, unidentified
  REGION 1..153: note = Description of Unknown:uncultivated organism with predicted taxonomy: Dialister
  REGION 1..153: note = MG15-49 RuvC-III domain
QDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2798 - protein, 153 aa, unidentified; identical to SEQ ID NO: 2751
  REGION 1..153: note = Description of Unknown:uncultivated organism with predicted taxonomy: Dialister
  REGION 1..153: note = MG15-50 RuvC-III domain

SEQ ID NO: 2799 - protein, 153 aa, unidentified; identical to SEQ ID NO: 2758
  REGION 1..153: note = Description of Unknown:uncultivated organism with predicted taxonomy: Dialister
  REGION 1..153: note = MG15-51 RuvC-III domain

SEQ ID NO: 2800 - protein, 153 aa, unidentified; identical to SEQ ID NO: 2797
  REGION 1..153: note = Description of Unknown:uncultivated organism with predicted taxonomy: Veillonellales
  REGION 1..153: note = MG15-52 RuvC-III domain

SEQ ID NO: 2801 - protein, 153 aa, unidentified; identical to SEQ ID NO: 2772
  REGION 1..153: note = Description of Unknown:uncultivated organism with predicted taxonomy: Dialisterinvisus
  REGION 1..153: note = MG15-53 RuvC-III domain

SEQ ID NO: 2802 - protein, 153 aa, unidentified; identical to SEQ ID NO: 2781
  REGION 1..153: note = Description of Unknown:uncultivated organism with predicted taxonomy: Dialister
  REGION 1..153: note = MG15-54 RuvC-III domain

SEQ ID NO: 2803 - protein, 167 aa, unidentified
  REGION 1..167: note = Description of Unknown:uncultivated organism with predicted taxonomy: Megasphaerastantonii
  REGION 1..167: note = MG15-55 RuvC-III domain
QDTQYISRFMLNYLQNNYELTPGNTNRKRRIIPVNGAVTAYVRKRLGISKIRENGDLHHAVDATVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHK

SEQ ID NO: 2804 - protein, 170 aa, unidentified; identical to SEQ ID NO: 2786
  REGION 1..170: note = Description of Unknown:uncultivated organism with predicted taxonomy: Selenomonasbovis
  REGION 1..170: note = MG15-56 RuvC-III domain

SEQ ID NO: 2805 - protein, 153 aa, unidentified; identical to SEQ ID NO: 2781
  REGION 1..153: note = Description of Unknown:uncultivated organism with predicted taxonomy: Dialister
  REGION 1..153: note = MG15-57 RuvC-III domain

SEQ ID NO: 2806 - protein, 153 aa, unidentified; identical to SEQ ID NO: 2794
  REGION 1..153: note = Description of Unknown:uncultivated organism with predicted taxonomy: Dialister
  REGION 1..153: note = MG15-58 RuvC-III domain

SEQ ID NO: 2807 - protein, 153 aa, unidentified; identical to SEQ ID NO: 2794
  REGION 1..153: note = Description of Unknown:uncultivated organism with predicted taxonomy: Dialister
  REGION 1..153: note = MG15-59 RuvC-III domain

SEQ ID NO: 2808 - protein, 153 aa, unidentified; identical to SEQ ID NO: 2772
  REGION 1..153: note = Description of Unknown:uncultivated organism with predicted taxonomy: Megasphaera
  REGION 1..153: note = MG15-60 RuvC-III domain

SEQ ID NO: 2809 - protein, 153 aa, unidentified; identical to SEQ ID NO: 2772
  REGION 1..153: note = Description of Unknown:uncultivated organism with predicted taxonomy: Dialister
  REGION 1..153: note = MG15-61 RuvC-III domain

SEQ ID NO: 2810 - protein, 167 aa, unidentified; identical to SEQ ID NO: 2766
  REGION 1..167: note = Description of Unknown:uncultivated organism with predicted taxonomy: Megasphaerastantonii
  REGION 1..167: note = MG15-62 RuvC-III domain

SEQ ID NO: 2811 - protein, 153 aa, unidentified; identical to SEQ ID NO: 2762
  REGION 1..153: note = Description of Unknown:uncultivated organism with predicted taxonomy: Dialister
  REGION 1..153: note = MG15-63 RuvC-III domain

SEQ ID NO: 2812 - protein, 153 aa, unidentified; identical to SEQ ID NO: 2794
  REGION 1..153: note = Description of Unknown:uncultivated organism with predicted taxonomy: Megasphaera
  REGION 1..153: note = MG15-64 RuvC-III domain

SEQ ID NO: 2813 - protein, 153 aa, unidentified; identical to SEQ ID NO: 2751
  REGION 1..153: note = Description of Unknown:uncultivated organism with predicted taxonomy: Dialister
  REGION 1..153: note = MG15-65 RuvC-III domain

SEQ ID NO: 2814 - protein, 167 aa, unidentified; identical to SEQ ID NO: 2766
  REGION 1..167: note = Description of Unknown:uncultivated organism with predicted taxonomy: Megasphaeramicronuciformis
  REGION 1..167: note = MG15-66 RuvC-III domain

SEQ ID NO: 2815 - protein, 167 aa, unidentified; identical to SEQ ID NO: 2766
  REGION 1..167: note = Description of Unknown:uncultivated organism with predicted taxonomy: Megasphaerastantonii
  REGION 1..167: note = MG15-67 RuvC-III domain

SEQ ID NO: 2816 - protein, 153 aa, unidentified
  REGION 1..153: note = Description of Unknown:uncultivated organism with predicted taxonomy: Veillonellaceaebacterium DNF00626
  REGION 1..153: note = MG15-68 RuvC-III domain
QDTQYISSYLYRYLMQNITLAPGYTDRKERIISLNGVVTGYVRKRWRIPKIRANGDLHHAVDAVVIACINDRLIKRVTEYSKAKELEYTPSDSGAVKTSMKDGFPEPWYCFRQELKARLSETPDEAIRNLHLATYCNVGNIKTPFVSRMLKCK

SEQ ID NO: 2817 - protein, 164 aa, unidentified
  REGION 1..164: note = Description of Unknown:uncultivated organism with predicted taxonomy: Dialister
  REGION 1..164: note = MG15-69 RuvC-III domain
QDTQYISRFLYNYLRNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEETIRRLRLPSYENAGEIKKPFVSRMPRRK

SEQ ID NO: 2818 - protein, 153 aa, unidentified; identical to SEQ ID NO: 2758
  REGION 1..153: note = Description of Unknown:uncultivated organism with predicted taxonomy: Dialister
  REGION 1..153: note = MG15-70 RuvC-III domain

SEQ ID NO: 2819 - protein, 153 aa, unidentified; identical to SEQ ID NO: 2794
  REGION 1..153: note = Description of Unknown:uncultivated organism with predicted taxonomy: Dialister
  REGION 1..153: note = MG15-71 RuvC-III domain

SEQ ID NO: 2820 - protein, 153 aa, unidentified; identical to SEQ ID NO: 2758
  REGION 1..153: note = Description of Unknown:uncultivated organism with predicted taxonomy: Dialister
  REGION 1..153: note = MG15-72 RuvC-III domain

SEQ ID NO: 2821 - protein, 153 aa, unidentified; identical to SEQ ID NO: 2772
  REGION 1..153: note = Description of Unknown:uncultivated organism with predicted taxonomy: Dialisterinvisus
  REGION 1..153: note = MG15-73 RuvC-III domain

SEQ ID NO: 2822 - protein, 153 aa, unidentified; identical to SEQ ID NO: 2772
  REGION 1..153: note = Description of Unknown:uncultivated organism with predicted taxonomy: Dialister
  REGION 1..153: note = MG15-74 RuvC-III domain

SEQ ID NO: 2823 - protein, 153 aa, unidentified; identical to SEQ ID NO: 2772
  REGION 1..153: note = Description of Unknown:uncultivated organism with predicted taxonomy: Dialisterinvisus
  REGION 1..153: note = MG15-75 RuvC-III domain

SEQ ID NO: 2824 - protein, 153 aa, unidentified; identical to SEQ ID NO: 2751
  REGION 1..153: note = Description of Unknown:uncultivated organism with predicted taxonomy: Dialister
  REGION 1..153: note = MG15-76 RuvC-III domain

SEQ ID NO: 2825 - protein, 153 aa, unidentified; identical to SEQ ID NO: 2781
  REGION 1..153: note = Description of Unknown:uncultivated organism with predicted taxonomy: Dialisterinvisus
  REGION 1..153: note = MG15-77 RuvC-III domain

SEQ ID NO: 2826 - protein, 153 aa, unidentified; identical to SEQ ID NO: 2772
  REGION 1..153: note = Description of Unknown:uncultivated organism with predicted taxonomy: Dialister
  REGION 1..153: note = MG15-78 RuvC-III domain

SEQ ID NO: 2827 - protein, 153 aa, unidentified; identical to SEQ ID NO: 2751
  REGION 1..153: note = Description of Unknown:uncultivated organism with predicted taxonomy: Megasphaerastantonii
  REGION 1..153: note = MG15-79 RuvC-III domain

SEQ ID NO: 2828 - protein, 153 aa, unidentified; identical to SEQ ID NO: 2755
  REGION 1..153: note = Description of Unknown:uncultivated organism with predicted taxonomy: Megasphaera sp.AM44-1BH
  REGION 1..153: note = MG15-80 RuvC-III domain

SEQ ID NO: 2829 - protein, 153 aa, unidentified; identical to SEQ ID NO: 2751
  REGION 1..153: note = Description of Unknown:uncultivated organism with predicted taxonomy: Megasphaera
  REGION 1..153: note = MG15-81 RuvC-III domain

SEQ ID NO: 2830 - protein, 153 aa, unidentified; identical to SEQ ID NO: 2755
  REGION 1..153: note = Description of Unknown:uncultivated organism with predicted taxonomy: Megasphaera sp.AM44-1BH
  REGION 1..153: note = MG15-82 RuvC-III domain

SEQ ID NO: 2831 - protein, 153 aa, unidentified; identical to SEQ ID NO: 2816
  REGION 1..153: note = Description of Unknown:uncultivated organism with predicted taxonomy: Veillonellaceaebacterium DNF00626
  REGION 1..153: note = MG15-83 RuvC-III domain

SEQ ID NO: 2832 - protein, 153 aa, unidentified; identical to SEQ ID NO: 2755
  REGION 1..153: note = Description of Unknown:uncultivated organism with predicted taxonomy: Dialister
  REGION 1..153: note = MG15-84 RuvC-III domain

SEQ ID NO: 2833 - protein, 153 aa, unidentified; identical to SEQ ID NO: 2755
  REGION 1..153: note = Description of Unknown:uncultivated organism with predicted taxonomy: Dialister
  REGION 1..153: note = MG15-85 RuvC-III domain

SEQ ID NO: 2834 - protein, 153 aa, unidentified; identical to SEQ ID NO: 2775
  REGION 1..153: note = Description of Unknown:uncultivated organism with predicted taxonomy: Dialister
  REGION 1..153: note = MG15-86 RuvC-III domain

SEQ ID NO: 2835 - protein, 153 aa, unidentified; identical to SEQ ID NO: 2779
  REGION 1..153: note = Description of Unknown:uncultivated organism with predicted taxonomy: Dialister
  REGION 1..153: note = MG15-87 RuvC-III domain

SEQ ID NO: 2836 - protein, 153 aa, unidentified; identical to SEQ ID NO: 2755
  REGION 1..153: note = Description of Unknown:uncultivated organism with predicted taxonomy: Megasphaera sp.AM44-1BH
  REGION 1..153: note = MG15-88 RuvC-III domain

SEQ ID NO: 2837 - protein, 153 aa, unidentified; identical to SEQ ID NO: 2755
  REGION 1..153: note = Description of Unknown:uncultivated organism with predicted taxonomy: Dialister
  REGION 1..153: note = MG15-89 RuvC-III domain

SEQ ID NO: 2838 - protein, 153 aa, unidentified; identical to SEQ ID NO: 2762
  REGION 1..153: note = Description of Unknown:uncultivated organism with predicted taxonomy: Dialister
  REGION 1..153: note = MG15-90 RuvC-III domain

SEQ ID NO: 2839 - protein, 153 aa, unidentified; identical to SEQ ID NO: 2794
  REGION 1..153: note = Description of Unknown:uncultivated organism with predicted taxonomy: Dialister
  REGION 1..153: note = MG15-91 RuvC-III domain

SEQ ID NO: 2840 - protein, 165 aa, unidentified; identical to SEQ ID NO: 2764
  REGION 1..165: note = Description of Unknown:uncultivated organism with predicted taxonomy: Firmicutes
  REGION 1..165: note = MG15-92 RuvC-III domain

SEQ ID NO: 2841 - protein, 167 aa, unidentified; identical to SEQ ID NO: 2763
  REGION 1..167: note = Description of Unknown:uncultivated organism with predicted taxonomy: Megasphaeramicronuciformis
  REGION 1..167: note = MG15-93 RuvC-III domain

SEQ ID NO: 2842 - protein, 153 aa, unidentified; identical to SEQ ID NO: 2797
  REGION 1..153: note = Description of Unknown:uncultivated organism with predicted taxonomy: Dialister
  REGION 1..153: note = MG15-94 RuvC-III domain

SEQ ID NO: 2843 - protein, 153 aa, unidentified; identical to SEQ ID NO: 2772
  REGION 1..153: note = Description of Unknown:uncultivated organism with predicted taxonomy: Dialister
  REGION 1..153: note = MG15-95 RuvC-III domain

SEQ ID NO: 2844 - protein, 167 aa, unidentified; identical to SEQ ID NO: 2766
  REGION 1..167: note = Description of Unknown:uncultivated organism with predicted taxonomy: Megasphaeramicronuciformis
  REGION 1..167: note = MG15-96 RuvC-III domain

SEQ ID NO: 2845 - protein, 167 aa, unidentified; identical to SEQ ID NO: 2767
  REGION 1..167: note = Description of Unknown:uncultivated organism with predicted taxonomy: Megasphaeramicronuciformis
  REGION 1..167: note = MG15-97 RuvC-III domain

SEQ ID NO: 2846 - protein, 153 aa, unidentified; identical to SEQ ID NO: 2751
  REGION 1..153: note = Description of Unknown:uncultivated organism with predicted taxonomy: Dialister
  REGION 1..153: note = MG15-98 RuvC-III domain

SEQ ID NO: 2847 - protein, 167 aa, unidentified; identical to SEQ ID NO: 2766
  REGION 1..167: note = Description of Unknown:uncultivated organism with predicted taxonomy: Megasphaeramicronuciformis
  REGION 1..167: note = MG15-99 RuvC-III domain

SEQ ID NO: 2848 - protein, 167 aa, unidentified; identical to SEQ ID NO: 2766
  REGION 1..167: note = Description of Unknown:uncultivated organism with predicted taxonomy: Megasphaerastantonii
  REGION 1..167: note = MG15-100 RuvC-III domain

SEQ ID NO: 2849 - protein, 153 aa, unidentified; identical to SEQ ID NO: 2772
  REGION 1..153: note = Description of Unknown:uncultivated organism with predicted taxonomy: Dialister
  REGION 1..153: note = MG15-101 RuvC-III domain

SEQ ID NO: 2850 - protein, 153 aa, unidentified; identical to SEQ ID NO: 2751
  REGION 1..153: note = Description of Unknown:uncultivated organism with predicted taxonomy: Megasphaera
  REGION 1..153: note = MG15-102 RuvC-III domain

SEQ ID NO: 2851 - protein, 165 aa, unidentified; identical to SEQ ID NO: 2789
  REGION 1..165: note = Description of Unknown:uncultivated organism with predicted taxonomy: Megasphaera sp.AM44-1BH
  REGION 1..165: note = MG15-103 RuvC-III domain

SEQ ID NO: 2852 - protein, 153 aa, unidentified; identical to SEQ ID NO: 2751
  REGION 1..153: note = Description of Unknown:uncultivated organism with predicted taxonomy: Dialister
  REGION 1..153: note = MG15-104 RuvC-III domain

SEQ ID NO: 2853 - protein, 167 aa, unidentified; identical to SEQ ID NO: 2767
  REGION 1..167: note = Description of Unknown:uncultivated organism with predicted taxonomy: Megasphaeramicronuciformis
  REGION 1..167: note = MG15-105 RuvC-III domain

SEQ ID NO: 2854 - protein, 153 aa, unidentified; identical to SEQ ID NO: 2751
  REGION 1..153: note = Description of Unknown:uncultivated organism with predicted taxonomy: Dialister
  REGION 1..153: note = MG15-106 RuvC-III domain

SEQ ID NO: 2855 - protein, 153 aa, unidentified; identical to SEQ ID NO: 2751
  REGION 1..153: note = Description of Unknown:uncultivated organism with predicted taxonomy: Dialister
  REGION 1..153: note = MG15-107 RuvC-III domain

SEQ ID NO: 2856 - protein, 153 aa, unidentified; identical to SEQ ID NO: 2751
  REGION 1..153: note = Description of Unknown:uncultivated organism with predicted taxonomy: Dialister
  REGION 1..153: note = MG15-108 RuvC-III domain

SEQ ID NO: 2857 - protein, 167 aa, unidentified; identical to SEQ ID NO: 2766
  REGION 1..167: note = Description of Unknown:uncultivated organism with predicted taxonomy: Megasphaerastantonii
  REGION 1..167: note = MG15-109 RuvC-III domain

SEQ ID NO: 2858 - protein, 153 aa, unidentified; identical to SEQ ID NO: 2762
  REGION 1..153: note = Description of Unknown:uncultivated organism with predicted taxonomy: Dialister
  REGION 1..153: note = MG15-110 RuvC-III domain

SEQ ID NO: 2859 - protein, 153 aa, unidentified; identical to SEQ ID NO: 2751
  REGION 1..153: note = Description of Unknown:uncultivated organism with predicted taxonomy: Veillonellales
  REGION 1..153: note = MG15-111 RuvC-III domain

SEQ ID NO: 2860 - protein, 153 aa, unidentified; identical to SEQ ID NO: 2772
  REGION 1..153: note = Description of Unknown:uncultivated organism with predicted taxonomy: Dialister
  REGION 1..153: note = MG15-112 RuvC-III domain

SEQ ID NO: 2861 - protein, 153 aa, unidentified; identical to SEQ ID NO: 2751
  REGION 1..153: note = Description of Unknown:uncultivated organism with predicted taxonomy: Dialister
  REGION 1..153: note = MG15-113 RuvC-III domain

SEQ ID NO: 2862 - protein, 164 aa, unidentified
  REGION 1..164: note = Description of Unknown:uncultivated organism with predicted taxonomy: Veillonellales
  REGION 1..164: note = MG15-114 RuvC-III domain
QDTQYISRFLYNYLKNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENVGEIKKPFVSRMPRRK

SEQ ID NO: 2863 - protein, 153 aa, unidentified; identical to SEQ ID NO: 2751
  REGION 1..153: note = Description of Unknown:uncultivated organism with predicted taxonomy: Dialister
  REGION 1..153: note = MG15-115 RuvC-III domain

SEQ ID NO: 2864 - protein, 153 aa, unidentified; identical to SEQ ID NO: 2755
  REGION 1..153: note = Description of Unknown:uncultivated organism with predicted taxonomy: Megasphaera sp.AM44-1BH
  REGION 1..153: note = MG15-116 RuvC-III domain

SEQ ID NO: 2865 - protein, 165 aa, unidentified; identical to SEQ ID NO: 2764
  REGION 1..165: note = Description of Unknown:uncultivated organism with predicted taxonomy: Megasphaera
  REGION 1..165: note = MG15-117 RuvC-III domain

SEQ ID NO: 2866 - protein, 153 aa, unidentified; identical to SEQ ID NO: 2781
  REGION 1..153: note = Description of Unknown:uncultivated organism with predicted taxonomy: Dialister
  REGION 1..153: note = MG15-118 RuvC-III domain

SEQ ID NO: 2867 - protein, 158 aa, unidentified; identical to SEQ ID NO: 2795
  REGION 1..158: note = Description of Unknown:uncultivated organism with predicted taxonomy: Dialister
  REGION 1..158: note = MG15-119 RuvC-III domain

SEQ ID NO: 2868 - protein, 167 aa, unidentified
  REGION 1..167: note = Description of Unknown:uncultivated organism with predicted taxonomy: Megasphaeramicronuciformis
  REGION 1..167: note = MG15-120 RuvC-III domain
QDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILNLPTYSPDEEIKTPFVSRMVRHK

SEQ ID NO: 2869 - protein, 167 aa, unidentified; identical to SEQ ID NO: 2763
  REGION 1..167: note = Description of Unknown:uncultivated organism with predicted taxonomy: Megasphaeramicronuciformis
  REGION 1..167: note = MG15-121 RuvC-III domain

SEQ ID NO: 2870 - protein, 153 aa, unidentified; identical to SEQ ID NO: 2772
  REGION 1..153: note = Description of Unknown:uncultivated organism with predicted taxonomy: Dialisterinvisus
  REGION 1..153: note = MG15-122 RuvC-III domain

SEQ ID NO: 2871 - protein, 153 aa, unidentified; identical to SEQ ID NO: 2758
  REGION 1..153: note = Description of Unknown:uncultivated organism with predicted taxonomy: Megasphaera
  REGION 1..153: note = MG15-123 RuvC-III domain

SEQ ID NO: 2872 - protein, 153 aa, unidentified; identical to SEQ ID NO: 2751
  REGION 1..153: note = Description of Unknown:uncultivated organism with predicted taxonomy: Dialister
  REGION 1..153: note = MG15-124 RuvC-III domain

SEQ ID NO: 2873 - protein, 153 aa, unidentified; identical to SEQ ID NO: 2781
  REGION 1..153: note = Description of Unknown:uncultivated organism with predicted taxonomy: Dialister
  REGION 1..153: note = MG15-125 RuvC-III domain

SEQ ID NO: 2874 - protein, 167 aa, unidentified
  REGION 1..167: note = Description of Unknown:uncultivated organism with predicted taxonomy: Megasphaerastantonii
  REGION 1..167: note = MG15-126 RuvC-III domain
QDTQYISRFMLNYLQNNYELTPGNTDRKRRIIPVNGAVTAYVRKRLGISKIRENGDLHHAVDATVIAAVTQGVVNSVSKYSKRHELQYHVDEHGNCVDLVTGKLMGDAFKENHKIKGFPEPWPQFRAELEARVSENAAEAIRTLNLPTYSSDEEIKTPFVSRMVRHK

SEQ ID NO: 2875 - protein, 153 aa, unidentified; identical to SEQ ID NO: 2794
  REGION 1..153: note = Description of Unknown:uncultivated organism with predicted taxonomy: Dialister
  REGION 1..153: note = MG15-127 RuvC-III domain

SEQ ID NO: 2876 - protein, 153 aa, unidentified; identical to SEQ ID NO: 2794
  REGION 1..153: note = Description of Unknown:uncultivated organism with predicted taxonomy: Dialisterinvisus
  REGION 1..153: note = MG15-128 RuvC-III domain

SEQ ID NO: 2877 - protein, 153 aa, unidentified; identical to SEQ ID NO: 2794
  REGION 1..153: note = Description of Unknown:uncultivated organism with predicted taxonomy: Dialister
  REGION 1..153: note = MG15-129 RuvC-III domain

SEQ ID NO: 2878 - protein, 153 aa, unidentified; identical to SEQ ID NO: 2755
  REGION 1..153: note = Description of Unknown:uncultivated organism with predicted taxonomy: Dialister
  REGION 1..153: note = MG15-130 RuvC-III domain

SEQ ID NO: 2879 - protein, 153 aa, unidentified; identical to SEQ ID NO: 2797
  REGION 1..153: note = Description of Unknown:uncultivated organism with predicted taxonomy: Dialister
  REGION 1..153: note = MG15-131 RuvC-III domain

SEQ ID NO: 2880 - protein, 167 aa, unidentified; identical to SEQ ID NO: 2790
  REGION 1..167: note = Description of Unknown:uncultivated organism with predicted taxonomy: Veillonellamagna
  REGION 1..167: note = MG15-132 RuvC-III domain

SEQ ID NO: 2881 - protein, 153 aa, unidentified; identical to SEQ ID NO: 2751
  REGION 1..153: note = Description of Unknown:uncultivated organism with predicted taxonomy: Dialister
  REGION 1..153: note = MG15-133 RuvC-III domain

SEQ ID NO: 2882 - protein, 167 aa, unidentified; identical to SEQ ID NO: 2766
  REGION 1..167: note = Description of Unknown:uncultivated organism with predicted taxonomy: Megasphaeramicronuciformis
  REGION 1..167: note = MG15-134 RuvC-III domain

SEQ ID NO: 2883 - protein, 167 aa, unidentified; identical to SEQ ID NO: 2766
  REGION 1..167: note = Description of Unknown:uncultivated organism with predicted taxonomy: Megasphaeramicronuciformis
  REGION 1..167: note = MG15-135 RuvC-III domain

SEQ ID NO: 2884 - protein, 146 aa, unidentified
  REGION 1..146: note = Description of Unknown:uncultivated organism with predicted taxonomy: Megasphaerastantonii
  REGION 1..146: note = MG15-136 RuvC-III domain
QDTQYISKYLYNYLLENLELAKGYTERKRRITPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFV

SEQ ID NO: 2885 - protein, 165 aa, unidentified; identical to SEQ ID NO: 2789
  REGION 1..165: note = Description of Unknown:uncultivated organism with predicted taxonomy: Megasphaera sp.AM44-1BH
  REGION 1..165: note = MG15-137 RuvC-III domain

SEQ ID NO: 2886 - protein, 165 aa, unidentified
  REGION 1..165: note = Description of Unknown:uncultivated organism with predicted taxonomy: Megasphaera
  REGION 1..165: note = MG15-138 RuvC-III domain
QDTQYISRYLYNYLRQHIPLKEGYTDRKRRIIPVNGAVTAYVRKRLGISKIRENGDLHHAVDAVIIACVTQGVVNKISCYSKIKELRQFMTADGTIVDKETGEVLQTANPRKTDPFPEPWPKFRQELEARVSDNPAEAIAALGLPTYEGIVSISAPFVSRMPNRK

SEQ ID NO: 2887 - protein, 165 aa, unidentified
  REGION 1..165: note = Description of Unknown:uncultivated organism with predicted taxonomy: Megasphaera
  REGION 1..165: note = MG15-139 RuvC-III domain
QDTQYISRYLYNYLKRHIELKEGYTDRKRRIIPVNGAVTAYVRKRLGISKIRENGDLHHAVDAVIIACVTQGVVNKISRYSKIKELRQFMTADGMIVDKETGEVLQTANPRKTDPFPEPWPKFRQELEARVSDNPAEAIAALGLPTYEGIVNISAPFVSRMPNRK

SEQ ID NO: 2888 - protein, 165 aa, unidentified
  REGION 1..165: note = Description of Unknown:uncultivated organism with predicted taxonomy: Megasphaera sp.AM44-1BH
  REGION 1..165: note = MG15-140 RuvC-III domain
QDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEMLTLKHVHKKDPFPEPWPHFRQELEARVGKQPQEAIAALHLPTYENVESIYTPFVSRMPNRK

SEQ ID NO: 2889 - protein, 153 aa, unidentified
  REGION 1..153: note = Description of Unknown:uncultivated organism with predicted taxonomy: Dialister
  REGION 1..153: note = MG15-141 RuvC-III domain
QDTQYISKYLYNYLRHHLVPAKGYTERKRRIISVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2890 - protein, 165 aa, unidentified
  REGION 1..165: note = Description of Unknown:uncultivated organism with predicted taxonomy: Megasphaera sp.AM44-1BH
  REGION 1..165: note = MG15-142 RuvC-III domain
QDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDLFPEPWPHFRQELVARVGKQPQEAIAALHLPTYENVESIYTPFVSRMPNRK

SEQ ID NO: 2891 - protein, 167 aa, unidentified; identical to SEQ ID NO: 2760
  REGION 1..167: note = Description of Unknown:uncultivated organism with predicted taxonomy: Megasphaeramicronuciformis
  REGION 1..167: note = MG15-143 RuvC-III domain

SEQ ID NO: 2892 - protein, 167 aa, unidentified; identical to SEQ ID NO: 2763
  REGION 1..167: note = Description of Unknown:uncultivated organism with predicted taxonomy: Megasphaerastantonii
  REGION 1..167: note = MG15-144 RuvC-III domain

SEQ ID NO: 2893 - protein, 167 aa, unidentified
  REGION 1..167: note = Description of Unknown:uncultivated organism with predicted taxonomy: Megasphaerastantonii
  REGION 1..167: note = MG15-145 RuvC-III domain
QDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWAQFRAELEARVSENAAEAIRILNLPTYSPDEEIKTPFVSRMVRHK

SEQ ID NO: 2894 - protein, 171 aa, unidentified
  REGION 1..171: note = Description of Unknown:uncultivated organism with predicted taxonomy: Megasphaerastantonii
  REGION 1..171: note = MG15-146 RuvC-III domain
NDTKYISSFVKNLLDDHLEFAPWLTGKNRHVMAVNGAVTDYTRKRLGIRKIREDGDLHHAVDAAVIAIVTQGNIQKLTNYSKQIERSRAFAKNPDGSYSDRETGEILKKDELIVRMSKHFPEPWPGFRRELEARVSDHPKELLESLRLPTYTPEELDALKPPFVSRMPTRK

SEQ ID NO: 2895 - protein, 158 aa, unidentified
  REGION 1..158: note = Description of Unknown:uncultivated organism with predicted taxonomy: Selenomonasruminantium
  REGION 1..158: note = MG15-147 RuvC-III domain
NDTRYITKLVKDLIEKYLEMAPFNTNRKRHVVAVNGAVTAYVRKRLGIAKIREDGDLHHAVDAAVIACVTEGMINRISRYSKRREILYNNKLVDEETGEIIKGKEDFPEPWPWFRKELDARTSKNPALLLREMKLPTYTEAELENLREPYVSRMPCHK

SEQ ID NO: 2896 - protein, 146 aa, unidentified
  REGION 1..146: note = Description of Unknown:uncultivated organism with predicted taxonomy: Selenomonas sp.AE3005
  REGION 1..146: note = MG15-148 RuvC-III domain
NDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWQGFRKELEARTSDNPAEELRRVQVKNYTEEELQAVKPIFVSRMPRRK

SEQ ID NO: 2897 - protein, 158 aa, unidentified
  REGION 1..158: note = Description of Unknown:uncultivated organism with predicted taxonomy: Selenomonasruminantium
  REGION 1..158: note = MG15-149 RuvC-III domain
NDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKGKEDFPEPWPWFRKELDARTSKNPALLIRGLKLPTYAEEELENLHEPYVSRMPCHK

SEQ ID NO: 2898 - protein, 171 aa, unidentified
  REGION 1..171: note = Description of Unknown:uncultivated organism with predicted taxonomy: Selenomonasruminantium
  REGION 1..171: note = MG15-150 RuvC-III domain
TDTKYIGSFVANLLRDHLDFAPWLNGRKQHVLVVNGAVTDYTRKRLGIRKIREDGDLHHAVDAAVIATVTQGNIQKLTNYSKQIERSRAFDKTANGSYADRETGEVLKKDELMVRMSKHFPEPWPGFRHELEARVSDHPKELLESLRLPTYTPEELDALKPPFVSRMPTRK

SEQ ID NO: 2899 - protein, 146 aa, unidentified
  REGION 1..146: note = Description of Unknown:uncultivated organism with predicted taxonomy: Selenomonas sp.AE3005
  REGION 1..146: note = MG15-151 RuvC-III domain
NDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRK

SEQ ID NO: 2900 - protein, 146 aa, unidentified
  REGION 1..146: note = Description of Unknown:uncultivated organism with predicted taxonomy: Selenomonas sp.AE3005
  REGION 1..146: note = MG15-152 RuvC-III domain
NDTKYISRFVYNLLRNHLEFNPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRK

SEQ ID NO: 2901 - protein, 146 aa, unidentified
  REGION 1..146: note = Description of Unknown:uncultivated organism with predicted taxonomy: Selenomonas sp.AE3005
  REGION 1..146: note = MG15-153 RuvC-III domain
NDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALNPIFVSRMPRRK

SEQ ID NO: 2902 - protein, 158 aa, unidentified
  REGION 1..158: note = Description of Unknown:uncultivated organism with predicted taxonomy: Selenomonasruminantium
  REGION 1..158: note = MG15-154 RuvC-III domain
NDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLIRELKLPTYAEEELENLHEPYVSRMPCHK

SEQ ID NO: 2903 - protein, 146 aa, unidentified
  REGION 1..146: note = Description of Unknown:uncultivated organism with predicted taxonomy: Selenomonas sp.AE3005
  REGION 1..146: note = MG15-155 RuvC-III domain
NDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRK

SEQ ID NO: 2904 - protein, 146 aa, unidentified; identical to SEQ ID NO: 2899
  REGION 1..146: note = Description of Unknown:uncultivated organism with predicted taxonomy: Selenomonas sp.AE3005
  REGION 1..146: note = MG15-156 RuvC-III domain

SEQ ID NO: 2905 - protein, 169 aa, unidentified
  REGION 1..169: note = Description of Unknown:uncultivated organism with predicted taxonomy: Megasphaerastantonii
  REGION 1..169: note = MG15-157 RuvC-III domain
NDTKYISSFVKNLLEDHLEFAPWLTGRKRHVMAVNGAVTDYTRKRLGIRKIREDGDLHHAVDAAVIAIVTQGNIQKLTNYSKRIEHAFIKNRDGSYTHPDTGEILKKDELMAQMSRHFPEPWPGFRRELEARVSDHPKELLESLRLPTYTPEEIDALKPPFVSRMPTRK

SEQ ID NO: 2906 - protein, 158 aa, unidentified
  REGION 1..158: note = Description of Unknown:uncultivated organism with predicted taxonomy: Selenomonasruminantium
  REGION 1..158: note = MG15-158 RuvC-III domain
NDTRYITKLVKDIIEKYLEMAPFKTTRKRNVVAVNGAVTAYVRKRLGIAKIRENGDLHHAVDAAVIACVTEGMINRISRYSKRREILYNNKLVDEETGEIIKGKEDFPEPWPWFRKELDARTGKNPALLIRDLKLPTYTEAELENLHEPYVSRMPCHK

SEQ ID NO: 2907 - protein, 158 aa, unidentified
  REGION 1..158: note = Description of Unknown:uncultivated organism with predicted taxonomy: Selenomonasruminantium
  REGION 1..158: note = MG15-159 RuvC-III domain
NDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLTRELKLPTYAEEELENLHEPYVSRMPCHK

SEQ ID NO: 2908 - protein, 169 aa, unidentified
  REGION 1..169: note = Description of Unknown:uncultivated organism with predicted taxonomy: Megasphaerastantonii
  REGION 1..169: note = MG15-160 RuvC-III domain
NDTKYISSFVKNLLEDHLEFAPWLTGKKRHVMAVNGAVTDYTRKRLGIRKIREDGDLHHAVDAAVIAIVTQGNIQKLTNYSKRIEHAFIKNRDGSYTHPDTGEILKKGELMAQMSRHFPEPWPGFRRELEARVSDHPKALLESLRLPTYTPEELDALKPPFVSRMPTRK

SEQ ID NO: 2909 - protein, 170 aa, unidentified; identical to SEQ ID NO: 2786
  REGION 1..170: note = Description of Unknown:uncultivated organism with predicted taxonomy: Selenomonas sp.AE3005
  REGION 1..170: note = MG15-161 RuvC-III domain

SEQ ID NO: 2910 - protein, 153 aa, unidentified; identical to SEQ ID NO: 2751
  REGION 1..153: note = Description of Unknown:uncultivated organism with predicted taxonomy: Megasphaera
  REGION 1..153: note = MG15-162 RuvC-III domain

SEQ ID NO: 2911 - protein, 153 aa, unidentified
  REGION 1..153: note = Description of Unknown:uncultivated organism with predicted taxonomy: Megasphaerastantonii
  REGION 1..153: note = MG15-163 RuvC-III domain
QDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRK

SEQ ID NO: 2912 - protein, 153 aa, unidentified; identical to SEQ ID NO: 2762
  REGION 1..153: note = Description of Unknown:uncultivated organism with predicted taxonomy: Megasphaera
  REGION 1..153: note = MG15-164 RuvC-III domain

SEQ ID NO: 2913 - protein, 153 aa, unidentified; identical to SEQ ID NO: 2751
  REGION 1..153: note = Description of Unknown:uncultivated organism with predicted taxonomy: Megasphaerastantonii
  REGION 1..153: note = MG15-165 RuvC-III domain

SEQ ID NO: 2914 - protein, 162 aa, unidentified
  REGION 1..162: note = Description of Unknown:uncultivated organism with predicted taxonomy: Bacteroidales
  REGION 1..162: note = MG16-2 RuvC-III domain
RETQYIAKKSVEILKQICRNVWTTSGSVTDFLRHNWGYDEILHTLDFDRYKSGGLTEVIEIEHKGQKHRIERIKDWSKRLDHRHHAVDALVVACTKQSYIQRLNNLNTERDAMYQDIEAQSVEWKEKHSLLEKWIKLQPHPTVSEVTDKVDEILVSFKAGKR

SEQ ID NO: 2915 - protein, 165 aa, unidentified
  REGION 1..165: note = Description of Unknown:uncultivated organism with predicted taxonomy: Bacteroidales
  REGION 1..165: note = MG16-5 RuvC-III domain
LQSQYIAKKAAEILRQGYRNVYATSGSVTDFLRHQWGYDEILHRLNLPRYQQVEGLTEDVTYDHCGQEHQQERIKGWTKRLDHRHHAIDALTIALTQQSVIQRLNTLNNSREQMFDELGKRTDTPEYTEKRSLLEKWVDAQPHFSVQEVTDKVDGILVSFRAGKR

SEQ ID NO: 2916 - protein, 165 aa, unidentified; identical to SEQ ID NO: 2915
  REGION 1..165: note = Description of Unknown:uncultivated organism with predicted taxonomy: Bacteroidetes
  REGION 1..165: note = MG16-6 RuvC-III domain

SEQ ID NO: 2917 - protein, 150 aa, unidentified
  REGION 1..150: note = Description of Unknown:uncultivated organism with predicted taxonomy: Bacteroides
  REGION 1..150: note = MG16-7 RuvC-III domain
VQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKK

SEQ ID NO: 2918 - protein, 150 aa, unidentified; identical to SEQ ID NO: 2917
  REGION 1..150: note = Description of Unknown:uncultivated organism with predicted taxonomy: Bacteroides
  REGION 1..150: note = MG16-8 RuvC-III domain

SEQ ID NO: 2919 - protein, 150 aa, unidentified; identical to SEQ ID NO: 2917
  REGION 1..150: note = Description of Unknown:uncultivated organism with predicted taxonomy: Bacteroides sp.CAG:770
  REGION 1..150: note = MG16-9 RuvC-III domain

SEQ ID NO: 2920 - protein, 150 aa, unidentified; identical to SEQ ID NO: 2917
  REGION 1..150: note = Description of Unknown:uncultivated organism with predicted taxonomy: Bacteroides
  REGION 1..150: note = MG16-10 RuvC-III domain

SEQ ID NO: 2921 - protein, 150 aa, unidentified; identical to SEQ ID NO: 2917
  REGION 1..150: note = Description of Unknown:uncultivated organism with predicted taxonomy: Bacteroides
  REGION 1..150: note = MG16-11 RuvC-III domain

SEQ ID NO: 2922 - protein, 165 aa, unidentified; identical to SEQ ID NO: 2915
  REGION 1..165: note = Description of Unknown:uncultivated organism with predicted taxonomy: Bacteroidetes
  REGION 1..165: note = MG16-12 RuvC-III domain

SEQ ID NO: 2923 - protein, 150 aa, unidentified; identical to SEQ ID NO: 2917
  REGION 1..150: note = Description of Unknown:uncultivated organism with predicted taxonomy: Bacteroides
  REGION 1..150: note = MG16-13 RuvC-III domain

SEQ ID NO: 2924 - protein, 150 aa, unidentified; identical to SEQ ID NO: 2917
  REGION 1..150: note = Description of Unknown:uncultivated organism with predicted taxonomy: Bacteroides sp.CAG:770
  REGION 1..150: note = MG16-14 RuvC-III domain

SEQ ID NO: 2925 - protein, 150 aa, unidentified
  REGION 1..150: note = Description of Unknown:uncultivated organism with predicted taxonomy: Bacteroides sp.CAG:770
  REGION 1..150: note = MG16-15 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2926 - protein, 150 aa, unidentified
  REGION 1..150: note = Description of Unknown:uncultivated organism with predicted taxonomy: Bacteroides sp.CAG:709
  REGION 1..150: note = MG16-16 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKK

SEQ ID NO: 2927 - protein, 150 aa, unidentified
  REGION 1..150: note = Description of Unknown:uncultivated organism with predicted taxonomy: Bacteroides sp.CAG:770
  REGION 1..150: note = MG16-17 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTQQSIIQRLNNLSAMTAVAGESMSLDKWTLAQPHFSVQKVSDNVSRILVSFKAGKK

SEQ ID NO: 2928 - protein, 150 aa, unidentified
  REGION 1..150: note = Description of Unknown:uncultivated organism with predicted taxonomy: Bacteroides sp.CAG:770
  REGION 1..150: note = MG16-18 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKTAIGEEQISLDKWTLAQAHFSVADVADHVADILVSFKSGKK

SEQ ID NO: 2929 - protein, 150 aa, unidentified
  REGION 1..150: note = Description of Unknown:uncultivated organism with predicted taxonomy: Bacteroides sp.CAG:770
  REGION 1..150: note = MG16-19 RuvC-III domain
VQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKR

SEQ ID NO: 2930 - protein, 150 aa, unidentified
  REGION 1..150: note = Description of Unknown:uncultivated organism with predicted taxonomy: Bacteroides sp.CAG:770
  REGION 1..150: note = MG16-20 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKK

SEQ ID NO: 2931 - protein, 150 aa, unidentified
  REGION 1..150: note = Description of Unknown:uncultivated organism with predicted taxonomy: Bacteroides sp.CAG:770
  REGION 1..150: note = MG16-21 RuvC-III domain
VQTQYVSRKAMEILNQVCRNVYGSSGDVTAYLRRIWGYDEILHSLDLPRYREGNLTGNVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2932 - protein, 150 aa, unidentified
  REGION 1..150: note = Description of Unknown:uncultivated organism with predicted taxonomy: Bacteroides sp.CAG:770
  REGION 1..150: note = MG16-22 RuvC-III domain
VQTQYISRKAMEILNQVCRNVYGSSGDVTAYLRRIWGYDEILHSLDLPRYRKGNLTGDVTYVHKGQTHTEERIKDWSKRLDHRHHAIDALTIACTRQSIIQRLNTLNAKTAIGEEQMSLDKWTLAQAHFSVADVADHVADILVSFKSGKR

SEQ ID NO: 2933 - protein, 150 aa, unidentified
  REGION 1..150: note = Description of Unknown:uncultivated organism with predicted taxonomy: Bacteroidales
  REGION 1..150: note = MG16-23 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNRSAMTAVAGESMSLDKWTLAQPHFSVQEVSDNVSRILVSFKAGKK

SEQ ID NO: 2934 - protein, 150 aa, unidentified
  REGION 1..150: note = Description of Unknown:uncultivated organism with predicted taxonomy: Bacteroides sp.CAG:770
  REGION 1..150: note = MG16-24 RuvC-III domain
VQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2935 - protein, 150 aa, unidentified
  REGION 1..150: note = Description of Unknown:uncultivated organism with predicted taxonomy: Bacteroides sp.CAG:770
  REGION 1..150: note = MG16-25 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKK

SEQ ID NO: 2936 - protein, 150 aa, unidentified; identical to SEQ ID NO: 2925
  REGION 1..150: note = Description of Unknown:uncultivated organism with predicted taxonomy: Bacteroides
  REGION 1..150: note = MG16-26 RuvC-III domain

SEQ ID NO: 2937 - protein, 150 aa, unidentified
  REGION 1..150: note = Description of Unknown:uncultivated organism with predicted taxonomy: Bacteroides sp.CAG:770
  REGION 1..150: note = MG16-27 RuvC-III domain
VQTQYISRKAMEILDQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 2938 - protein, 150 aa, unidentified
  REGION 1..150: note = Description of Unknown:uncultivated organism with predicted taxonomy: Bacteroides sp.CAG:545
  REGION 1..150: note = MG16-28 RuvC-III domain
VQTQYISRKAMEILKQVCHNVYGSSGEVTSYLRRIWGYDEILHTLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2939 - protein, 150 aa, unidentified
  REGION 1..150: note = Description of Unknown:uncultivated organism with predicted taxonomy: Bacteroides sp.CAG:709
  REGION 1..150: note = MG16-29 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 2940 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-30 RuvC-III domain

SEQ ID NO: 2941 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-31 RuvC-III domain

SEQ ID NO: 2942 - protein, 150 aa, unidentified
  REGION 1..150: note = Description of Unknown:uncultivated organism with predicted taxonomy: Alistipes sp.CAG:514
  REGION 1..150: note = MG16-32 RuvC-III domain
VQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKK

SEQ ID NO: 2943 - protein, 150 aa, unidentified; identical to SEQ ID NO: 2942
  REGION 1..150: note = Description of Unknown:uncultivated organism with predicted taxonomy: Alistipes sp.CAG:514
  REGION 1..150: note = MG16-33 RuvC-III domain

SEQ ID NO: 2944 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-34 RuvC-III domain

SEQ ID NO: 2945 - protein, 150 aa, unidentified
  REGION 1..150: note = Description of Unknown:uncultivated organism with predicted taxonomy: Bacteroides sp.CAG:770
  REGION 1..150: note = MG16-35 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIACTRQSIIQKLNTLNAKTAIGEEQISLDKWTLAQAHFSVADVADHVADILVSFKSGKK

SEQ ID NO: 2946 - protein, 150 aa, unidentified
  REGION 1..150: note = Description of Unknown:uncultivated organism with predicted taxonomy: Bacteroides
  REGION 1..150: note = MG16-36 RuvC-III domain
VQTQYISRKAMEILKQVCHNVYGSSGEVTSYLRRIWGYDKILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2947 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-37 RuvC-III domain

SEQ ID NO: 2948 - protein, 150 aa, unidentified; identical to SEQ ID NO: 2946
  REGION 1..150: note = Description of Unknown:uncultivated organism with predicted taxonomy: Bacteroides
  REGION 1..150: note = MG16-38 RuvC-III domain

SEQ ID NO: 2949 - protein, 150 aa, unidentified; identical to SEQ ID NO: 2929
  REGION 1..150: note = Description of Unknown:uncultivated organism with predicted taxonomy: Bacteroides sp.CAG:770
  REGION 1..150: note = MG16-39 RuvC-III domain

SEQ ID NO: 2950 - protein, 150 aa, unidentified
  REGION 1..150: note = Description of Unknown:uncultivated organism with predicted taxonomy: Bacteroides sp.CAG:770
  REGION 1..150: note = MG16-40 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSIIQRLNNLSSMTAVAGEAMSLDKWTLAQPHFSVQEVSDKVGGILVSFKAGKK

SEQ ID NO: 2951 - protein, 150 aa, unidentified
  REGION 1..150: note = Description of Unknown:uncultivated organism with predicted taxonomy: Bacteroides sp.CAG:770
  REGION 1..150: note = MG16-42 RuvC-III domain
VQTQYISRKAMEILNQVCRNVYGSSGDVTAYLRRIWGYDEILHSLDLPRYREGNLTGDVTYVHMGQTHTEERIKDWSKRLDHRHHAIDALTIACTRQSIIQRLNTLNAKTAIGEEQMSLDKWTLAQAHFSVADVSDHVADILVSFKSGKK

SEQ ID NO: 2952 - protein, 150 aa, unidentified; identical to SEQ ID NO: 2951
  REGION 1..150: note = Description of Unknown:uncultivated organism with predicted taxonomy: Bacteroides sp.CAG:770
  REGION 1..150: note = MG16-43 RuvC-III domain

SEQ ID NO: 2953 - protein, 150 aa, unidentified
  REGION 1..150: note = Description of Unknown:uncultivated organism with predicted taxonomy: Bacteroides sp.CAG:770
  REGION 1..150: note = MG16-44 RuvC-III domain
VQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2954 - protein, 150 aa, unidentified; identical to SEQ ID NO: 2945
  REGION 1..150: note = Description of Unknown:uncultivated organism with predicted taxonomy: Bacteroides sp.CAG:770
  REGION 1..150: note = MG16-45 RuvC-III domain

SEQ ID NO: 2955 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-46 RuvC-III domain

SEQ ID NO: 2956 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-47 RuvC-III domain

SEQ ID NO: 2957 - protein, 150 aa, unidentified
  REGION 1..150: note = Description of Unknown:uncultivated organism with predicted taxonomy: Bacteroides sp.CAG:770
  REGION 1..150: note = MG16-48 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKK

SEQ ID NO: 2958 - protein, 150 aa, unidentified; identical to SEQ ID NO: 2957
  REGION 1..150: note = Description of Unknown:uncultivated organism with predicted taxonomy: Bacteroides sp.CAG:770
  REGION 1..150: note = MG16-50 RuvC-III domain

SEQ ID NO: 2959 - protein, 150 aa, unidentified; identical to SEQ ID NO: 2957
  REGION 1..150: note = Description of Unknown:uncultivated organism with predicted taxonomy: Bacteroides sp.CAG:770
  REGION 1..150: note = MG16-51 RuvC-III domain

SEQ ID NO: 2960 - protein, 150 aa, unidentified
  REGION 1..150: note = Description of Unknown:uncultivated organism with predicted taxonomy: Bacteroides sp.CAG:770
  REGION 1..150: note = MG16-52 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2961 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-53 RuvC-III domain

SEQ ID NO: 2962 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-54 RuvC-III domain

SEQ ID NO: 2963 - protein, 150 aa, unidentified
  REGION 1..150: note = Description of Unknown:uncultivated organism with predicted taxonomy: Bacteroides sp.CAG:770
  REGION 1..150: note = MG16-55 RuvC-III domain
VQTQYISRKAMDILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKAAIGEEQMSLDKWTLAQAHFSVADVADHVADILVSFKSGKK

SEQ ID NO: 2964 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-56 RuvC-III domain

SEQ ID NO: 2965 - protein, 150 aa, unidentified; identical to SEQ ID NO: 2929
  REGION 1..150: note = Description of Unknown:uncultivated organism with predicted taxonomy: Bacteroides sp.CAG:770
  REGION 1..150: note = MG16-57 RuvC-III domain

SEQ ID NO: 2966 - protein, 150 aa, unidentified
  REGION 1..150: note = Description of Unknown:uncultivated organism with predicted taxonomy: Bacteroides sp.CAG:770
  REGION 1..150: note = MG16-58 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKR

SEQ ID NO: 2967 - protein, 150 aa, unidentified
  REGION 1..150: note = Description of Unknown:uncultivated organism with predicted taxonomy: Bacteroides sp.CAG:770
  REGION 1..150: note = MG16-59 RuvC-III domain
VQTQYISRKAMEILKQVCHNVYGSSGEVTSYLRRIWGYDEILHSLDLPRYREGGMTAEVSYDHRGQTHTEERIKDWSKRLEHRHHAIDALTIACTRQSIIQRLNNLSAMTAVAGESMSLDKWTLAQPHFSVQEVSDNVSRILVSFKAGKK

SEQ ID NO: 2968 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-60 RuvC-III domain

SEQ ID NO: 2969 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-61 RuvC-III domain

SEQ ID NO: 2970 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-62 RuvC-III domain

SEQ ID NO: 2971 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-63 RuvC-III domain

SEQ ID NO: 2972 - protein, 150 aa, unidentified; identical to SEQ ID NO: 2942
  REGION 1..150: note = Description of Unknown:uncultivated organism with predicted taxonomy: Alistipes sp.CAG:514
  REGION 1..150: note = MG16-64 RuvC-III domain

SEQ ID NO: 2973 - protein, 150 aa, unidentified
  REGION 1..150: note = Description of Unknown:uncultivated organism with predicted taxonomy: Bacteroides sp.CAG:770
  REGION 1..150: note = MG16-65 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 2974 - protein, 150 aa, unidentified
  REGION 1..150: note = Description of Unknown:uncultivated organism with predicted taxonomy: Bacteroides sp.CAG:770
  REGION 1..150: note = MG16-66 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGEYMSLDKWTLAQPHFSVQEVSDNVSRILVSFKAGKK

SEQ ID NO: 2975 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-67 RuvC-III domain

SEQ ID NO: 2976 - protein, 150 aa, unidentified; identical to SEQ ID NO: 2930
  REGION 1..150: note = Description of Unknown:uncultivated organism with predicted taxonomy: Bacteroides sp.CAG:770
  REGION 1..150: note = MG16-68 RuvC-III domain

SEQ ID NO: 2977 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-69 RuvC-III domain

SEQ ID NO: 2978 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-70 RuvC-III domain

SEQ ID NO: 2979 - protein, 150 aa, unidentified; identical to SEQ ID NO: 2938
  REGION 1..150: note = Description of Unknown:uncultivated organism with predicted taxonomy: Bacteroides sp.CAG:545
  REGION 1..150: note = MG16-72 RuvC-III domain

SEQ ID NO: 2980 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-73 RuvC-III domain

SEQ ID NO: 2981 - protein, 150 aa, unidentified
  REGION 1..150: note = Description of Unknown:uncultivated organism with predicted taxonomy: Bacteroides sp.CAG:770
  REGION 1..150: note = MG16-74 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNANTAIGEEQISLDKWTLAQAHFSVADVADHVADILVSFKSGKK

SEQ ID NO: 2982 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-75 RuvC-III domain

SEQ ID NO: 2983 - protein, 150 aa, unidentified; identical to SEQ ID NO: 2939
  REGION 1..150: note = Description of Unknown:uncultivated organism with predicted taxonomy: Bacteroides
  REGION 1..150: note = MG16-76 RuvC-III domain

SEQ ID NO: 2984 - protein, 150 aa, unidentified
  REGION 1..150: note = Description of Unknown:uncultivated organism with predicted taxonomy: Bacteroides sp.CAG:770
  REGION 1..150: note = MG16-77 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKR

SEQ ID NO: 2985 - protein, 150 aa, unidentified; identical to SEQ ID NO: 2925
  REGION 1..150: note = Description of Unknown:uncultivated organism with predicted taxonomy: Bacteroides
  REGION 1..150: note = MG16-78 RuvC-III domain

SEQ ID NO: 2986 - protein, 150 aa, unidentified
  REGION 1..150: note = Description of Unknown:uncultivated organism with predicted taxonomy: Bacteroides sp.CAG:770
  REGION 1..150: note = MG16-79 RuvC-III domain
IQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2987 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-80 RuvC-III domain

SEQ ID NO: 2988 - protein, 150 aa, unidentified
  REGION 1..150: note = Description of Unknown:uncultivated organism with predicted taxonomy: Bacteroides
  REGION 1..150: note = MG16-81 RuvC-III domain
VQTQYISRKAMEILKQVCHNVYGSSGEVTSYLRRIWGYDVILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 2989 - protein, 150 aa, unidentified; identical to SEQ ID NO: 2930
  REGION 1..150: note = Description of Unknown:uncultivated organism with predicted taxonomy: Bacteroides sp.CAG:770
  REGION 1..150: note = MG16-82 RuvC-III domain

SEQ ID NO: 2990 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-83 RuvC-III domain

SEQ ID NO: 2991 - protein, 165 aa, unidentified
  REGION 1..165: note = Description of Unknown:uncultivated organism with predicted taxonomy: Bacteroidetes
  REGION 1..165: note = MG16-84 RuvC-III domain
RQSQYIAKKAAEILRQGVRNVYATSGSVTDFLRHQWGYDNILHYLNLPRYQQVDGLTESVTYDHCGQKHQEERIKDWTKRLDHRHHAIDALTIALTQQSVIQRLNTLNASREEMKNDLGQRIDTPEYTEKRSLLEKWVDIQPHFSVQEVTDKVDGILISFRAGKR

SEQ ID NO: 2992 - protein, 150 aa, unidentified; identical to SEQ ID NO: 2925
  REGION 1..150: note = Description of Unknown:uncultivated organism with predicted taxonomy: Bacteroides
  REGION 1..150: note = MG16-85 RuvC-III domain

SEQ ID NO: 2993 - protein, 150 aa, unidentified
  REGION 1..150: note = Description of Unknown:uncultivated organism with predicted taxonomy: Bacteroides sp.CAG:545
  REGION 1..150: note = MG16-86 RuvC-III domain
VQTQYISRKAMEILKQVCHNVYGSSGEVTSYLRRIWGYDEILHSLDLPRYREGGMTAEVSYDHLGQTHTEERIKDWSKRLDHRHHAIDALTIACTRQSIIQRLNNLSAMSAVAGESMSLDKWTLAQPHFSVQEVSDNVSRILVSFKAGKK

SEQ ID NO: 2994 - protein, 150 aa, unidentified; identical to SEQ ID NO: 2993
  REGION 1..150: note = Description of Unknown:uncultivated organism with predicted taxonomy: Bacteroides
  REGION 1..150: note = MG16-87 RuvC-III domain

SEQ ID NO: 2995 - protein, 150 aa, unidentified; identical to SEQ ID NO: 2926
  REGION 1..150: note = Description of Unknown:uncultivated organism with predicted taxonomy: Bacteroides
  REGION 1..150: note = MG16-88 RuvC-III domain

SEQ ID NO: 2996 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-89 RuvC-III domain

SEQ ID NO: 2997 - protein, 150 aa, unidentified; identical to SEQ ID NO: 2966
  REGION 1..150: note = Description of Unknown:uncultivated organism with predicted taxonomy: Bacteroides sp.CAG:770
  REGION 1..150: note = MG16-90 RuvC-III domain

SEQ ID NO: 2998 - protein, 150 aa, unidentified; identical to SEQ ID NO: 2966
  REGION 1..150: note = Description of Unknown:uncultivated organism with predicted taxonomy: Bacteroides sp.CAG:770
  REGION 1..150: note = MG16-91 RuvC-III domain

SEQ ID NO: 2999 - protein, 150 aa, unidentified; identical to SEQ ID NO: 2942
  REGION 1..150: note = Description of Unknown:uncultivated organism with predicted taxonomy: Alistipes sp.CAG:514
  REGION 1..150: note = MG16-92 RuvC-III domain

SEQ ID NO: 3000 - protein, 150 aa, unidentified; identical to SEQ ID NO: 2942
  REGION 1..150: note = Description of Unknown:uncultivated organism with predicted taxonomy: Alistipes sp.CAG:514
  REGION 1..150: note = MG16-93 RuvC-III domain

SEQ ID NO: 3001 - protein, 150 aa, unidentified
  REGION 1..150: note = Description of Unknown:uncultivated organism with predicted taxonomy: Bacteroides sp.CAG:545
  REGION 1..150: note = MG16-94 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSYNVSRILVSFKAGKK

SEQ ID NO: 3002 - protein, 150 aa, unidentified
  REGION 1..150: note = Description of Unknown:uncultivated organism with predicted taxonomy: Bacteroides sp.CAG:709
  REGION 1..150: note = MG16-95 RuvC-III domain
VQTQYISRKAMEILKQVCHNVYGSSGEVTSYLRRIWGYDEILHSLDLPRYREGGMTAEVSYEHRGQIHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 3003 - protein, 150 aa, unidentified; identical to SEQ ID NO: 2925
  REGION 1..150: note = Description of Unknown:uncultivated organism with predicted taxonomy: Bacteroides
  REGION 1..150: note = MG16-96 RuvC-III domain

SEQ ID NO: 3004 - protein, 150 aa, unidentified; identical to SEQ ID NO: 2925
  REGION 1..150: note = Description of Unknown:uncultivated organism with predicted taxonomy: Bacteroides
  REGION 1..150: note = MG16-97 RuvC-III domain

SEQ ID NO: 3005 - protein, 150 aa, unidentified
  REGION 1..150: note = Description of Unknown:uncultivated organism with predicted taxonomy: Bacteroides sp.CAG:770
  REGION 1..150: note = MG16-98 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 3006 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-99 RuvC-III domain

SEQ ID NO: 3007 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-100 RuvC-III domain

SEQ ID NO: 3008 - protein, 150 aa, unidentified
  REGION 1..150: note = Description of Unknown:uncultivated organism with predicted taxonomy: Bacteroides sp.CAG:545
  REGION 1..150: note = MG16-101 RuvC-III domain
VQTQYISRKAMEILKQVCHNVYGSSGEVTSYLRRIWGYDEILHSLDLPRYREGGMTSEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 3009 - protein, 150 aa, unidentified
  REGION 1..150: note = Description of Unknown:uncultivated organism with predicted taxonomy: Bacteroides sp.CAG:770
  REGION 1..150: note = MG16-102 RuvC-III domain
VQTQYISRKAMEILNQVCRNVYCSSGDVTAYLRRIWGYDEILHSLDLPRYREGNLTGDVTYVHMGQTHTEERIKDWSKRMDHRHHAIDALTIACTRQSIIQRLNTLNAKTAIGEEQMSLDKWTLAQAHFSVADVADHVADILVSFKSGKR

SEQ ID NO: 3010 - protein, 150 aa, unidentified; identical to SEQ ID NO: 2953
  REGION 1..150: note = Description of Unknown:uncultivated organism with predicted taxonomy: Bacteroides sp.CAG:770
  REGION 1..150: note = MG16-103 RuvC-III domain

SEQ ID NO: 3011 - protein, 150 aa, unidentified; identical to SEQ ID NO: 2939
  REGION 1..150: note = Description of Unknown:uncultivated organism with predicted taxonomy: Bacteroides
  REGION 1..150: note = MG16-104 RuvC-III domain

SEQ ID NO: 3012 - protein, 150 aa, unidentified
  REGION 1..150: note = Description of Unknown:uncultivated organism with predicted taxonomy: Bacteroides sp.CAG:770
  REGION 1..150: note = MG16-105 RuvC-III domain
VQTQYISRKAMEILNQVCRNVYGSSGDVTAYLRRIWGYDEILHSLDLPRYREGNLTENVTYVHRGQTHTEERIKDWSKRLDHRHHAIDALTIACTRQSIIQRLNTLNAKTAIGEEQMSLDKWTLAQTHFSVADVADHVADILVSFKSGKR

SEQ ID NO: 3013 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-106 RuvC-III domain

SEQ ID NO: 3014 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-107 RuvC-III domain

SEQ ID NO: 3015 - protein, 150 aa, unidentified; identical to SEQ ID NO: 2932
  REGION 1..150: note = Description of Unknown:uncultivated organism with predicted taxonomy: Bacteroides sp.CAG:770
  REGION 1..150: note = MG16-108 RuvC-III domain

SEQ ID NO: 3016 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-109 RuvC-III domain

SEQ ID NO: 3017 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-110 RuvC-III domain

SEQ ID NO: 3018 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-113 RuvC-III domain

SEQ ID NO: 3019 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-114 RuvC-III domain

SEQ ID NO: 3020 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-115 RuvC-III domain

SEQ ID NO: 3021 - protein, 150 aa, unidentified; identical to SEQ ID NO: 2925
  REGION 1..150: note = Description of Unknown:uncultivated organism with predicted taxonomy: Bacteroides
  REGION 1..150: note = MG16-116 RuvC-III domain

SEQ ID NO: 3022 - protein, 150 aa, unidentified; identical to SEQ ID NO: 2973
  REGION 1..150: note = Description of Unknown:uncultivated organism with predicted taxonomy: Bacteroides sp.CAG:770
  REGION 1..150: note = MG16-118 RuvC-III domain

SEQ ID NO: 3023 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-119 RuvC-III domain

SEQ ID NO: 3024 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-120 RuvC-III domain

SEQ ID NO: 3025 - protein, 150 aa, unidentified
  REGION 1..150: note = Description of Unknown:uncultivated organism with predicted taxonomy: Bacteroides sp.CAG:770
  REGION 1..150: note = MG16-121 RuvC-III domain
VQTQYISRKAMEILNQVCRNVYGSSGDVTAYLRRIWGYDEILHSLDLPRYREGNLTGDVTYLHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 3026 - protein, 150 aa, unidentified
  REGION 1..150: note = Description of Unknown:uncultivated organism with predicted taxonomy: Bacteroides sp.CAG:770
  REGION 1..150: note = MG16-122 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKR

SEQ ID NO: 3027 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-123 RuvC-III domain

SEQ ID NO: 3028 - protein, 150 aa, unidentified
  REGION 1..150: note = Description of Unknown:uncultivated organism with predicted taxonomy: Bacteroides sp.CAG:770
  REGION 1..150: note = MG16-126 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMAAVAGESMSLDKWTLAQPHFSVQEVSDNVSRILVSFKAGKK

SEQ ID NO: 3029 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-127 RuvC-III domain

SEQ ID NO: 3030 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-128 RuvC-III domain

SEQ ID NO: 3031 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-129 RuvC-III domain

SEQ ID NO: 3032 - protein, 150 aa, unidentified
  REGION 1..150: note = Description of Unknown:uncultivated organism with predicted taxonomy: Bacteroides sp.CAG:770
  REGION 1..150: note = MG16-130 RuvC-III domain
VQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 3033 - protein, 150 aa, unidentified
  REGION 1..150: note = Description of Unknown:uncultivated organism with predicted taxonomy: Bacteroides sp.CAG:709
  REGION 1..150: note = MG16-131 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSMQEVSDKVGGILVSFKAGKK

SEQ ID NO: 3034 - protein, 150 aa, unidentified; identical to SEQ ID NO: 2925
  REGION 1..150: note = Description of Unknown:uncultivated organism with predicted taxonomy: Bacteroides
  REGION 1..150: note = MG16-132 RuvC-III domain

SEQ ID NO: 3035 - protein, 159 aa, unidentified
  REGION 1..159: note = Description of Unknown:uncultivated organism with predicted taxonomy: Bacteroidales
  REGION 1..159: note = MG16-133 RuvC-III domain
RLSQYISKKAQELLKKSCREVIATSGSVTDLIRHTWGYDTILHELNLPCYKEAGLTTFIKEENTGQQKEVIKDWTKRLDHRHHAVDALTVACTSRSIIQHINTLHASREVMRGDVKTPRKEWENNDLLQQWIKEKMPFDRQYVLQKVASILVSMKSGKK

SEQ ID NO: 3036 - protein, 166 aa, unidentified
  REGION 1..166: note = Description of Unknown:uncultivated organism
  REGION 1..166: note = MG16-134 RuvC-III domain
GETQYISREAIKILKQCCKNVNATSGAVTAILRHLWGYDEILHQLDFERYKKAGLTKIVTWESDHGKNKHTKEQIVNWTKRIDHRHHAIDALVIACTQQGFVQRINTLNADETKDLMKKQIESSGVKFEEKKDLLNKYLASLTPFSTQTVADNVDKILVSFKAGKK

SEQ ID NO: 3037 - protein, 166 aa, unidentified
  REGION 1..166: note = Description of Unknown:uncultivated organism with predicted taxonomy: Porphyromonassp. oral taxon 278
  REGION 1..166: note = MG16-135 RuvC-III domain
GETQYISREAIRILKQCCRYVNATSGSITATLRHLWGYDEILHQLNFERYKQAGLTKIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKK

SEQ ID NO: 3038 - protein, 162 aa, unidentified
  REGION 1..162: note = Description of Unknown:uncultivated organism with predicted taxonomy: Bacteroidales
  REGION 1..162: note = MG16-136 RuvC-III domain
RQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKM

SEQ ID NO: 3039 - protein, 159 aa, unidentified
  REGION 1..159: note = Description of Unknown:uncultivated organism with predicted taxonomy: Prevotella
  REGION 1..159: note = MG16-137 RuvC-III domain
RLSQYISRKAQELLRMTCRDVTVTTGEITALIRHTWGYDTILHDLNFSSYKEAGLTEIVKGEDSGRTREIIKDWSKRLDHRHHAIDALAVACTSRSIVQRINTLNASREEIRGEIKAPRKEWKDSNLLQQWIKEKMPFDRQYVLHKVASILISMKAGKK

SEQ ID NO: 3040 - protein, 162 aa, unidentified
  REGION 1..162: note = Description of Unknown:uncultivated organism
  REGION 1..162: note = MG16-138 RuvC-III domain
RQSQYISKKAVEMLKQVCRNVWTTSGSVTDFIRHQWGYDNILHDLNFKRYKDAGQTEIIISDHLGQVHQEERIKNWTKRLDHRHHAIDALTIASTKQSYIQRLNHLNSSRDKMFQELEAQSKEVKEKYSLLESWMRCRPHIPVSVVSQAIDGILVSFKTGKR

SEQ ID NO: 3041 - protein, 163 aa, unidentified
  REGION 1..163: note = Description of Unknown:uncultivated organism with predicted taxonomy: Bacteroidales
  REGION 1..163: note = MG16-139 RuvC-III domain
RQSQYIAVKAVEILQQGIRRVWTSGGSVTDFLRHQWGYDEILHTLNLPRYKQVDEMTEWVHYEHAGQEHEVERIKNWTKRLDHRHHAIDALTVALTQQSMIQRLNTLEASHDEMEKQVKEANTPYKEKKSILEKWVTEQPHFEVSEVTDKVDSILVSFRAGKR

SEQ ID NO: 3042 - protein, 126 aa, unidentified
  REGION 1..126: note = Description of Unknown:uncultivated organism with predicted taxonomy: Fibrobacter
  REGION 1..126: note = MG16-140 RuvC-III domain
RQTQYIAKKALEMLKEICYNVYATSGSVTDFIRRTWGYDEILHQLNFDRYKKGGLTELREYEHKGETHTEERIQDWSKRLDHRHHAIDALVIAMTRQSIIQRLNHLNTERDAMFQEVEKQRKDWKN

SEQ ID NO: 3043 - protein, 100 aa, unidentified
  REGION 1..100: note = Description of Unknown:uncultivated organism with predicted taxonomy: Bacteroidales
  REGION 1..100: note = MG16-141 RuvC-III domain
RQSQYIAVKAVEILQQGIRQVWTSGGSVTDFLRHQWGYDEILHTLNLPRYRKVEDLTEIVHYEHAGQEHDEERIKNWSKRIDHRHHAIDALTVALTRQAY

SEQ ID NO: 3044 - protein, 163 aa, unidentified
  REGION 1..163: note = Description of Unknown:uncultivated organism with predicted taxonomy: Bacteroidales
  REGION 1..163: note = MG16-142 RuvC-III domain
RQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKR

SEQ ID NO: 3045 - protein, 162 aa, unidentified
  REGION 1..162: note = Description of Unknown:uncultivated organism with predicted taxonomy: Deminuibactersoli
  REGION 1..162: note = MG16-143 RuvC-III domain
RQSQYIAKKAVDMLKQVCRNVWTTSGSVTDFLRHNWGYDQILHDLNLPRYKEGGMTEMVHYEHNGQEHDEERIIGWTKRLDHRHHAIDALTIASTRQSYIQRLNTLYASRDAMHAEIKKQSAHWQEKHSLLEEWTKQRPHLPVSVVRDSVDGILVSFKPGKR

SEQ ID NO: 3046 - protein, 166 aa, unidentified
  REGION 1..166: note = Description of Unknown:uncultivated organism with predicted taxonomy: Bacteroidales
  REGION 1..166: note = MG16-144 RuvC-III domain
GETQYISRESIRILKQCCRNVNATSGSITATLRHLWGYDEVLHQLNFERFKNAGLTETVTWESNHGKNKHSKEQIIDWSKRVDHRHHAIDALVVACTQQGFIQRINTLNADETKDLMKRQIETVGVKYDEKKILLDKYLTSLAPFKTQTVANAASNILVSFKPGKK

SEQ ID NO: 3047 - protein, 166 aa, unidentified
  REGION 1..166: note = Description of Unknown:uncultivated organism with predicted taxonomy: Bacteroides
  REGION 1..166: note = MG16-145 RuvC-III domain
RETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKR

SEQ ID NO: 3048 - protein, 162 aa, unidentified
  REGION 1..162: note = Description of Unknown:uncultivated organism with predicted taxonomy: Bacteroidetes
  REGION 1..162: note = MG16-146 RuvC-III domain
RQSQYISKKAVEMLKQVCRNVWTTSGSVTDFVRHHWGYDNIIHDLNFQRNKNAGQTAIITYEHRGQTHQEERIKEWSKRLDHRHHAIDALTIASTKQSYIQRLNHLNTSRDAMFQELEAQSEEFKEKYSLLERWIKERPHIPVSEVTEAVDGILVSFKAGKR

SEQ ID NO: 3049 - protein, 163 aa, unidentified
  REGION 1..163: note = Description of Unknown:uncultivated organism with predicted taxonomy: Bacteroidales
  REGION 1..163: note = MG16-147 RuvC-III domain
RQSQYIAVKAVEVLQDGIRHVWTSGGSVTDFLRHQWGYDEILHTLNLPRYRQVEGLTEYVEFEHAGQKHTEERIKNWSKRIDHRHHAIDALTVALTQQGYIQRLNTLEASHDLMEKQVKEAGTHYNEKKSILEKWINEQPHFSVEDVTNVVKGILVSFRAGKR

SEQ ID NO: 3050 - protein, 163 aa, unidentified
  REGION 1..163: note = Description of Unknown:uncultivated organism with predicted taxonomy: Bacteroidales
  REGION 1..163: note = MG16-148 RuvC-III domain
RQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEDVTNAVDGILVSFRAGKR

SEQ ID NO: 3051 - protein, 166 aa, unidentified
  REGION 1..166: note = Description of Unknown:uncultivated organism with predicted taxonomy: Bacteroidetes
  REGION 1..166: note = MG16-149 RuvC-III domain
GETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKK

SEQ ID NO: 3052 - protein, 159 aa, unidentified
  REGION 1..159: note = Description of Unknown:uncultivated organism with predicted taxonomy: Bacteroidales
  REGION 1..159: note = MG16-150 RuvC-III domain
RLSQYISRKAMEILRMGCREVVATSGSITELIRHTWGYDTILHELNCPDYKEAGLTEIIIDEKTKRQREVISDWTKRLDHRHHAIDALAVACTTHSIVQHINTLHASRKIMRDEIKTSRKEWKDNYLLQQWIKEKMPFDRHYVLHKIASILVSMKAGKK

SEQ ID NO: 3053 - protein, 166 aa, unidentified; identical to SEQ ID NO: 3047
  REGION 1..166: note = Description of Unknown:uncultivated organism with predicted taxonomy: Prevotella
  REGION 1..166: note = MG16-151 RuvC-III domain

SEQ ID NO: 3054 - protein, 162 aa, unidentified
  REGION 1..162: note = Description of Unknown:uncultivated organism with predicted taxonomy: Fibrobacter
  REGION 1..162: note = MG16-152 RuvC-III domain
RQTQYISKKALEMLKEVCRNVYATSGSVTDFIRHTWGYDEILHQLNFDRYKQGGLTEAREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKR

SEQ ID NO: 3055 - protein, 163 aa, unidentified
  REGION 1..163: note = Description of Unknown:uncultivated organism with predicted taxonomy: Bacteroidales
  REGION 1..163: note = MG16-153 RuvC-III domain
RQSQYIAVKAVEILQQGIRQVWTSGGSVTDFLRHQWGYDEILHTLNLPRYRQVEDLTEMVHYEHAGQEHDEERIKNWSKRIDHRHHAIDALTVALTRQAYIQRLNTLEASHDFMEKQVKEAGTQYNEKKSILEKWILEQPHFSVDDVTQSVDSILVSFRAGKR

SEQ ID NO: 3056 - protein, 163 aa, unidentified
  REGION 1..163: note = Description of Unknown:uncultivated organism with predicted taxonomy: Bacteroidales
  REGION 1..163: note = MG16-154 RuvC-III domain
RQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKR

SEQ ID NO: 3057 - protein, 162 aa, unidentified
  REGION 1..162: note = Description of Unknown:uncultivated organism with predicted taxonomy: Bacteroidales
  REGION 1..162: note = MG16-155 RuvC-III domain
RQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKR

SEQ ID NO: 3058 - protein, 163 aa, unidentified; identical to SEQ ID NO: 3044
  REGION 1..163: note = Description of Unknown:uncultivated organism with predicted taxonomy: Bacteroidales
  REGION 1..163: note = MG16-156 RuvC-III domain

SEQ ID NO: 3059 - protein, 162 aa, unidentified
  REGION 1..162: note = Description of Unknown:uncultivated organism with predicted taxonomy: Fibrobacter
  REGION 1..162: note = MG16-157 RuvC-III domain
RQTQYIAKKALEMLKEVCYNVYATSGSVTDFIRHTWGYDEILHQLNFDRYKKGGLTELREFDHKGATHTEERIQNWSKRLDHRHHAIDALVIAMTRQSIIQRLNHLNTERDAMFQEVEKQSKEWKNDYSLLQEWLRERKHFSTDEVAQKVSDILASFKAGKR

SEQ ID NO: 3060 - protein, 162 aa, unidentified
  REGION 1..162: note = Description of Unknown:uncultivated organism with predicted taxonomy: Bacteroidetes
  REGION 1..162: note = MG16-158 RuvC-III domain
RQSQYISRKAVDMLKLVCRNVWTTSGSVTDFLRHNWGYDQILHDLNLPRYKEGGMTEVVHYEHNGQEHDEERIIGWTKRMDHRHHAIDALTIACTRQSYIQRLNTLNASRDAMHAEIEKQNAYWQEKHSLLEEWTRQRPHLPVSVVRDYVDGILVSFKPGKK

SEQ ID NO: 3061 - protein, 163 aa, unidentified
  REGION 1..163: note = Description of Unknown:uncultivated organism with predicted taxonomy: Bacteroidetes
  REGION 1..163: note = MG16-159 RuvC-III domain
RQSQYIARKSVEMLQQVCKNVYSTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTR

SEQ ID NO: 3062 - protein, 162 aa, unidentified
  REGION 1..162: note = Description of Unknown:uncultivated organism with predicted taxonomy: Fibrobacter
  REGION 1..162: note = MG16-160 RuvC-III domain
RQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKR

SEQ ID NO: 3063 - protein, 163 aa, unidentified
  REGION 1..163: note = Description of Unknown:uncultivated organism with predicted taxonomy: Bacteroidales
  REGION 1..163: note = MG16-161 RuvC-III domain
RQSQYIAVKAVEILQQGIRKVWTSGGSVTDFLRHQWGYDEVLHTLNLPRYHKVEGMTEFVQYEHAGQTHEEERIKNWTKRVDHRHHAIDALTVALTRQAYIQRLNTLEASHDLMEKQVKDAGTLYNEKKSILEKWINEQPHFSVDEVTRQVDGILISFRAGKR

SEQ ID NO: 3064 - protein, 163 aa, unidentified
  REGION 1..163: note = Description of Unknown:uncultivated organism with predicted taxonomy: Prevotella
  REGION 1..163: note = MG16-162 RuvC-III domain
RQSQYIARKAIEMLQQICKNVYSTSGRVTDFVRHQWGYDEILHDLNFDRYKKAGLTTMVTQLQSGDEVEVERIKDWTKRLDNRHHAVDALAIACTTQGMIQRLNTLNASRDEMQAELNDKNGSIMDPNRSMLEKWVSIQPHITYAEAKNEVDKIIISQRPNTR

SEQ ID NO: 3065 - protein, 166 aa, unidentified; identical to SEQ ID NO: 3047
  REGION 1..166: note = Description of Unknown:uncultivated organism with predicted taxonomy: Bacteroides
  REGION 1..166: note = MG16-163 RuvC-III domain

SEQ ID NO: 3066 - protein, 163 aa, unidentified
  REGION 1..163: note = Description of Unknown:uncultivated organism with predicted taxonomy: Prevotella
  REGION 1..163: note = MG16-164 RuvC-III domain
RQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTR

SEQ ID NO: 3067 - protein, 165 aa, unidentified
  REGION 1..165: note = Description of Unknown:uncultivated organism
  REGION 1..165: note = MG16-165 RuvC-III domain
RQSQYIAVKAVEILQQGIRQVWTSGGSVTDFLRHQWGYDEILHTLNLPRYRQVEDLTEIVHYEHAGQEHDEERIKNWSKRIDHRHHAIDALTVALTRQAYIKRLNSLNAEFTREEMLKEVEEANTVYNEKKSLLEKWILEQPHFSVDDVTNSVDSILVSFRAGKR

SEQ ID NO: 3068 - protein, 162 aa, unidentified
  REGION 1..162: note = Description of Unknown:uncultivated organism with predicted taxonomy: Bacteroidales
  REGION 1..162: note = MG16-166 RuvC-III domain
RLSQYIAKKSVEMLQQICRNVYVTSGSVTDFVRHQWGYDELLHDLNFERYKKAGLTAMVKQLHSGKEVEVERIKDWTKRLDNRHHAVDALAIACTTQGMIQRLNTLNASRDDMLEELNSKKRVADPNRSMLEKWLYAQPHVSYALAKEELDKIIVSQRPNTR

SEQ ID NO: 3069 - protein, 165 aa, unidentified
  REGION 1..165: note = Description of Unknown:uncultivated organism with predicted taxonomy: Bacteroidales
  REGION 1..165: note = MG16-167 RuvC-III domain
RLSQYIAVKAVDLLQQGIRQVWASSGTVTFFMRHQWGYDEILHTLNLPRYRRVEGMTEFVDFEHAGQKHTEERIKNWSKRIDHRHHAIDALTIALTRQAYIQSLNTLSSEITREEMIEIIKETGKVYKEKTSLLDKWARELPHFSVEDVTNAVDGILVSFRAGKR

SEQ ID NO: 3070 - protein, 159 aa, unidentified
  REGION 1..159: note = Description of Unknown:uncultivated organism with predicted taxonomy: Barnesiellaviscericola
  REGION 1..159: note = MG16-168 RuvC-III domain
RLSQYISRKAQELLRTACRDVIATSGSITDLIRHTWGYDTILHELNFDCYKKAGLTEFIKDEKTGKNREVIQDWTKRLDHRHHAIDALAVACTSRSIIQRINTLHASREDIRKEIKSTRKEWQENDLLQQWIKEKMPFDRKYVLHKVASILVSMKAGKK

SEQ ID NO: 3071 - protein, 163 aa, unidentified; identical to SEQ ID NO: 3044
  REGION 1..163: note = Description of Unknown:uncultivated organism with predicted taxonomy: Bacteroidales
  REGION 1..163: note = MG16-169 RuvC-III domain

SEQ ID NO: 3072 - protein, 162 aa, unidentified; identical to SEQ ID NO: 3040
  REGION 1..162: note = Description of Unknown:uncultivated organism
  REGION 1..162: note = MG16-170 RuvC-III domain

SEQ ID NO: 3073 - protein, 163 aa, unidentified; identical to SEQ ID NO: 3063
  REGION 1..163: note = Description of Unknown:uncultivated organism with predicted taxonomy: Bacteroidales
  REGION 1..163: note = MG16-171 RuvC-III domain

SEQ ID NO: 3074 - protein, 118 aa, unidentified
  REGION 1..118: note = Description of Unknown:uncultivated organism with predicted taxonomy: Prevotellabrevis
  REGION 1..118: note = MG16-172 RuvC-III domain
RQSQYIAVKAVEILQQAIRQVWTSGGSVTDFLRHQWGYDEILHTLNLPRYRQVEDLTEIVHYEHAGQEHEEERIKNWSKRIDHRHHAIDALTVALTRQAYIQRLNSLNAEFTREEMLK

SEQ ID NO: 3075 - protein, 166 aa, unidentified; identical to SEQ ID NO: 3047
  REGION 1..166: note = Description of Unknown:uncultivated organism with predicted taxonomy: Bacteroides
  REGION 1..166: note = MG16-173 RuvC-III domain

SEQ ID NO: 3076 - protein, 163 aa, unidentified
  REGION 1..163: note = Description of Unknown:uncultivated organism with predicted taxonomy: Bacteroidetes
  REGION 1..163: note = MG16-174 RuvC-III domain
RQSQYIAVKAVEVLQDGIRQVWTSGGSVTDFLRHQWGYDEILHTLNLPRYRQVEGLTEFVDYEHAGQKHTEERIKNWTKRIDHRHHAIDALTVALTQQGYIQRLNTLEASHDFMEKQVKETGTHYNEKKSILEKWINEQPHFSVEDVTSAVDGILVSFRAGKR

SEQ ID NO: 3077 - protein, 159 aa, unidentified
  REGION 1..159: note = Description of Unknown:uncultivated organism with predicted taxonomy: Prevotella
  REGION 1..159: note = MG16-175 RuvC-III domain
RLSQYISRKAQELLRTACRDVIATSGSITDLIRHTWGYDTILHELNFDCYKKAGLTEFIKDEKTGKIREVIQDWTKRLDHRHHAIDALAVACTSRSIIQRINTLHASREDIRKEIKSTRKEWQENDLLQQWIKEKMPFDRKYVLHKVASILVSMKAGKK

SEQ ID NO: 3078 - protein, 163 aa, unidentified; identical to SEQ ID NO: 3056
  REGION 1..163: note = Description of Unknown:uncultivated organism with predicted taxonomy: Bacteroidales
  REGION 1..163: note = MG16-176 RuvC-III domain

SEQ ID NO: 3079 - protein, 163 aa, unidentified; identical to SEQ ID NO: 3055
  REGION 1..163: note = Description of Unknown:uncultivated organism with predicted taxonomy: Bacteroidia
  REGION 1..163: note = MG16-177 RuvC-III domain

SEQ ID NO: 3080 - protein, 163 aa, unidentified; identical to SEQ ID NO: 3044
  REGION 1..163: note = Description of Unknown:uncultivated organism with predicted taxonomy: Porphyromonassp. oral taxon 278
  REGION 1..163: note = MG16-178 RuvC-III domain

SEQ ID NO: 3081 - protein, 162 aa, unidentified; identical to SEQ ID NO: 3040
  REGION 1..162: note = Description of Unknown:uncultivated organism
  REGION 1..162: note = MG16-179 RuvC-III domain

SEQ ID NO: 3082 - protein, 165 aa, unidentified
  REGION 1..165: note = Description of Unknown:uncultivated organism with predicted taxonomy: Bacteroidales
  REGION 1..165: note = MG16-180 RuvC-III domain
RQSQYIAVKAVEILQQGIRQVWTSGGSVTDCLRHQWGYDEILHTLNLPRYRQVEDLTEIVHYEHAGQEHDEERIKNWSKRIDHRHHAIDALTVALTRQAYITRLNSLNAEFTREEMLKEVEEANTVYNEKKSLLEKWVNEQPHFSVEDVTQSVDGILVSFRAGKR

SEQ ID NO: 3083 - protein, 163 aa, unidentified; identical to SEQ ID NO: 3044
  REGION 1..163: note = Description of Unknown:uncultivated organism with predicted taxonomy: Bacteroidales
  REGION 1..163: note = MG16-181 RuvC-III domain

SEQ ID NO: 3084 - protein, 163 aa, unidentified
  REGION 1..163: note = Description of Unknown:uncultivated organism with predicted taxonomy: Prevotella
  REGION 1..163: note = MG16-182 RuvC-III domain
RQSQYIARKSVEMLQQICKNVYFTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTR

SEQ ID NO: 3085 - protein, 43 aa, unidentified
  REGION 1..43: note = Description of Unknown:uncultivated organism with predicted taxonomy: Prevotella
  REGION 1..43: note = MG16-183 RuvC-III domain
RLSPYIARKSVEMLQQICKNVYSTSGSVTDFVRHQWGYDEILH

SEQ ID NO: 3086 - protein, 163 aa, unidentified
  REGION 1..163: note = Description of Unknown:uncultivated organism with predicted taxonomy: Bacteroidales
  REGION 1..163: note = MG16-184 RuvC-III domain
RQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKETGTQYNEKKSILEKWVAEQPHFPVADVTENVDGILVSFRAGKR

SEQ ID NO: 3087 - protein, 162 aa, unidentified; identical to SEQ ID NO: 3062
  REGION 1..162: note = Description of Unknown:uncultivated organism with predicted taxonomy: Fibrobacter
  REGION 1..162: note = MG16-185 RuvC-III domain

SEQ ID NO: 3088 - protein, 163 aa, unidentified; identical to SEQ ID NO: 3066
  REGION 1..163: note = Description of Unknown:uncultivated organism with predicted taxonomy: Prevotella
  REGION 1..163: note = MG16-186 RuvC-III domain

SEQ ID NO: 3089 - protein, 163 aa, unidentified
  REGION 1..163: note = Description of Unknown:uncultivated organism with predicted taxonomy: Bacteroidales
  REGION 1..163: note = MG16-187 RuvC-III domain
RQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKR

SEQ ID NO: 3090 - protein, 163 aa, unidentified
  REGION 1..163: note = Description of Unknown:uncultivated organism
  REGION 1..163: note = MG16-188 RuvC-III domain
RQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3091 - protein, 163 aa, unidentified; identical to SEQ ID NO: 3090
  REGION 1..163: note = Description of Unknown:uncultivated organism
  REGION 1..163: note = MG16-189 RuvC-III domain

SEQ ID NO: 3092 - protein, 163 aa, unidentified
  REGION 1..163: note = Description of Unknown:uncultivated organism with predicted taxonomy: Prevotellaruminicola
  REGION 1..163: note = MG16-190 RuvC-III domain
RQSQYIAKKSVEMLQQVCKNVYTTSGSVTDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTR

SEQ ID NO: 3093 - protein, 163 aa, unidentified; identical to SEQ ID NO: 3089
  REGION 1..163: note = Description of Unknown:uncultivated organism with predicted taxonomy: Labilibaculumfiliforme
  REGION 1..163: note = MG16-191 RuvC-III domain

SEQ ID NO: 3094 - protein, 163 aa, unidentified
  REGION 1..163: note = Description of Unknown:uncultivated organism with predicted taxonomy: Bacteroidales
  REGION 1..163: note = MG16-192 RuvC-III domain
RQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3095 - protein, 162 aa, unidentified
  REGION 1..162: note = Description of Unknown:uncultivated organism
  REGION 1..162: note = MG16-193 RuvC-III domain
RQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKR

SEQ ID NO: 3096 - protein, 47 aa, unidentified
  REGION 1..47: note = Description of Unknown:uncultivated organism with predicted taxonomy:Sediminibacterium sp. C3
  REGION 1..47: note = MG16-194 RuvC-III domain
RLSQYIAKKSVEMLQQVCRNVYSTSGSVTDFVRHQWGYDELLHDLNF

SEQ ID NO: 3097 - protein, 161 aa, unidentified
  REGION 1..161: note = Description of Unknown:uncultivated organism with predicted taxonomy: Bacteroides
  REGION 1..161: note = MG16-195 RuvC-III domain
RLSQYISKKAMEILSFGCRDVVATSGSITAIIRHAWGWDTILEELNIQTYRNANLTEVIEVKSKGQNKKMETIKNWTKRLDNRHHAIDALVVACTSSSIIQRINTLNASKQKMRDEITSARKKWDENNILTQWIREKNPLNRKEVLEHVSSIFISMKAGKK

SEQ ID NO: 3098 - protein, 163 aa, unidentified; identical to SEQ ID NO: 3094
  REGION 1..163: note = Description of Unknown:uncultivated organism with predicted taxonomy:Gammaproteobacteria bacterium
  REGION 1..163: note = MG16-196 RuvC-III domain

SEQ ID NO: 3099 - protein, 159 aa, unidentified
  REGION 1..159: note = Description of Unknown:uncultivated organism with predicted taxonomy: Bacteroides
  REGION 1..159: note = MG16-197 RuvC-III domain
RLSQYISKKAQEILKTACREVVATSGTITDLIRHTWGYDTILHELNFPNYKEAGLTSFVTDEKTNQQREVIKDWSKRLDHRHHAVDALAVACTSRSIVQHINTLHASRDEMRKEVNSARKDWKDNNLLQQWIMEKKPFDRQYVLHKVASILVSMKAGKR

SEQ ID NO: 3100 - protein, 105 aa, unidentified
  REGION 1..105: note = Description of Unknown:uncultivated organism with predicted taxonomy: Bacteroidales
  REGION 1..105: note = MG16-198 RuvC-III domain
RQSQYIAKKSVDMLQQVCKNVYTTSGSVTDFVRHQWGYDELLHELNFERFKKAGLTAMVKQLHSGKEIEVERIKDWTKRLDNRHHAVDALAIACTTQGMIQRLNT

SEQ ID NO: 3101 - protein, 163 aa, unidentified
  REGION 1..163: note = Description of Unknown:uncultivated organism with predicted taxonomy:Gammaproteobacteria bacterium
  REGION 1..163: note = MG16-199 RuvC-III domain
RQSQYIAKKSVDMLQQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3102 - protein, 162 aa, unidentified
  REGION 1..162: note = Description of Unknown:uncultivated organism with predicted taxonomy: Fibrobacter
  REGION 1..162: note = MG16-200 RuvC-III domain
RQTQYIAKKALEMLKDVCYNVYATSGSVTDFIRHTWGYDEILHQLNFDRYKKGGLTELREYDHKGETHTEERIQDWSKRLDHRHHAIDALVIAMTRQSIIQRLNHLNTERDAMFQEVEKQSKEWKNDYSMLQEWLRERKHFSTEDVAKKVSDILVSFKAGKR

SEQ ID NO: 3103 - protein, 166 aa, unidentified
  REGION 1..166: note = Description of Unknown:uncultivated organism with predicted taxonomy: Prevotella
  REGION 1..166: note = MG16-201 RuvC-III domain
GETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKK

SEQ ID NO: 3104 - protein, 163 aa, unidentified
  REGION 1..163: note = Description of Unknown:uncultivated organism
  REGION 1..163: note = MG16-202 RuvC-III domain
RQSQYIAKKAVEILKDGIREVWTSGGSVTDFLRHQWGYDEILHTLNLPRYQQVEGLTETIQYEHAGQTHEEERIKNWTKRIDHRHHAIDALTVALTQQAYIQRLNTLEASHDHMQKVVNEAGTQYNEKKSLLEKWVAEQPHFSVADVTDKVDGILVSFRAGKR

SEQ ID NO: 3105 - protein, 159 aa, unidentified
  REGION 1..159: note = Description of Unknown:uncultivated organism with predicted taxonomy: Bacteroides sp.CAG:144
  REGION 1..159: note = MG16-203 RuvC-III domain
RLSQYITKKAHELLRTACRDVLATSGSITDLTRHVWGYDTILHELNLPRYKSAGITEVITDERTGREQEVIRDWNKRLDHRHHAIDALAVACTSRSMIQRINTLHASREEMREEVSSPRKDWKENDLLRQWIKEQRPFERQYVLHKVESILVSMKAGKK

SEQ ID NO: 3106 - protein, 163 aa, unidentified
  REGION 1..163: note = Description of Unknown:uncultivated organism with predicted taxonomy: Bacteroidales
  REGION 1..163: note = MG16-204 RuvC-III domain
RQSQYIAKKSVEMLQLVCKNVYTTSGSVTDFVRHQWGYDELLHELNFERFKKAGLTAMVKQMHSGKEIEVERIKDWTKRLDNRHHAVDALAIACTTQGMIQRLNTLNASREEMLEELSINDQRLIDPERSMLEKWLFVQPHISYAEAKNEINKIVISQRPNTR

SEQ ID NO: 3107 - protein, 162 aa, unidentified; identical to SEQ ID NO: 3102
  REGION 1..162: note = Description of Unknown:uncultivated organism with predicted taxonomy: Fibrobacter
  REGION 1..162: note = MG16-205 RuvC-III domain

SEQ ID NO: 3108 - protein, 163 aa, unidentified
  REGION 1..163: note = Description of Unknown:uncultivated organism with predicted taxonomy:Gammaproteobacteria bacterium
  REGION 1..163: note = MG16-206 RuvC-III domain
RQSQYIAKKSVEILQQVCKDVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3109 - protein, 159 aa, unidentified
  REGION 1..159: note = Description of Unknown:uncultivated organism
  REGION 1..159: note = MG16-207 RuvC-III domain
RLSQYITKKAHELLRTACRDVLATSGSITDLTRHVWGYDTILHELNLPRYKSAGITEVITDERTGREQEVIKDWNKRLDHRHHAIDALAVACTSRSMIQRINTLHASREEMREEVSSPRRDWKENDLLRQWIKEQLPFERQYVLHKVESILVSMKAGKK

SEQ ID NO: 3110 - protein, 163 aa, unidentified
  REGION 1..163: note = Description of Unknown:uncultivated organism
  REGION 1..163: note = MG16-208 RuvC-III domain
RQSQMIARKSFEVLRQICHNVYATSGSVTDFLRHQWGYDNILHDLNFERFSKSDNIEEITIVGRDGIETKVKRIKGWNKRIDNRHHAVDALTIALTTQSMIQRLNTLYASRDAMHGDIEASKQKFNEKKSILEKWTAIQPHFTYSQASEAISRILISQRGGKR

SEQ ID NO: 3111 - protein, 166 aa, unidentified; identical to SEQ ID NO: 3103
  REGION 1..166: note = Description of Unknown:uncultivated organism with predicted taxonomy:Chryseobacterium vrystaatense
  REGION 1..166: note = MG16-209 RuvC-III domain

SEQ ID NO: 3112 - protein, 162 aa, unidentified
  REGION 1..162: note = Description of Unknown:uncultivated organism
  REGION 1..162: note = MG16-210 RuvC-III domain
RQSQYISKKAIEMLKQICRYVWATSGSVTDFIRHNWGYDKILHDLNFERYKSGGLTEMVHYDHQGQEHDEERIKEWTKRLDHRHHALDALTIASTQQGYIQRLNHLNTERDQMFAELEMQREEYKGRYSLLEEWIKERPHISVEDAKVAVDQIAVSFKAGKK

SEQ ID NO: 3113 - protein, 166 aa, unidentified
  REGION 1..166: note = Description of Unknown:uncultivated organism with predicted taxonomy: Prevotella
  REGION 1..166: note = MG16-211 RuvC-III domain
GETQYISRESIRILKQCCRTVNATSGKITAILRHLWGYDEILHQLNFERYKKAGLTETKTWESNHGKNKHSKEQIVDWSKRIDHRHHAIDALVVACTQQGVIQRINTLNADETKDLMKKQIESANIKYEEKKVLLDKYLTSLVPFNTKTVAEAVNKILVSFKAGKK

SEQ ID NO: 3114 - protein, 163 aa, unidentified; identical to SEQ ID NO: 3064
  REGION 1..163: note = Description of Unknown:uncultivated organism with predicted taxonomy: Prevotellaihumii
  REGION 1..163: note = MG16-212 RuvC-III domain

SEQ ID NO: 3115 - protein, 162 aa, unidentified
  REGION 1..162: note = Description of Unknown:uncultivated organism with predicted taxonomy: Treponema pedis
  REGION 1..162: note = MG16-213 RuvC-III domain
RQSQYISKKAVEMLKQVCRYVWTTSGSVTDFLRQTWGYNNILHDLNFERYKSGGLTEIRQYDHKGQEQSKECIIGWTKRLDHRHHALDALTIASTQQGYIQRLNHLNTERDEMFAELKKQSEEHKEKHSLLEDWMKERPHLSVEAVKEAVDQIAVSFKAGKK

SEQ ID NO: 3116 - protein, 163 aa, unidentified
  REGION 1..163: note = Description of Unknown:uncultivated organism with predicted taxonomy:Sediminibacterium sp. C3
  REGION 1..163: note = MG16-214 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWIVVQPHISYSEAKNEIDKIVISQRPNTR

SEQ ID NO: 3117 - protein, 163 aa, unidentified
  REGION 1..163: note = Description of Unknown:uncultivated organism with predicted taxonomy: Prevotella
  REGION 1..163: note = MG16-215 RuvC-III domain
RQSQYIAKKSVEMLQQVCKNVYTTSGSVTDFVRHQWGYDDLLHDLNFERFKKAGLTAMVKQLHSGKEVEMERIKDWTKRLDNRHHAVDALAIACTTQGMIQRLNTLNASRDEILEELNSKDQRVVDPERSMLEKWVYAQPHISYAEAKNEIDKIVISQRPNTR

SEQ ID NO: 3118 - protein, 163 aa, unidentified
  REGION 1..163: note = Description of Unknown:uncultivated organism with predicted taxonomy: Bacteroidales
  REGION 1..163: note = MG16-216 RuvC-III domain
RQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTR

SEQ ID NO: 3119 - protein, 163 aa, unidentified
  REGION 1..163: note = Description of Unknown:uncultivated organism with predicted taxonomy: Porphyromonascatoniae
  REGION 1..163: note = MG16-217 RuvC-III domain
RQSQYIAKKSVEMLQQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3120 - protein, 163 aa, unidentified
  REGION 1..163: note = Description of Unknown:uncultivated organism with predicted taxonomy: Prevotella
  REGION 1..163: note = MG16-218 RuvC-III domain
RQSQYIAKKSVEMLQQVCKNVYTTSGSITDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTR

SEQ ID NO: 3121 - protein, 162 aa, unidentified
  REGION 1..162: note = Description of Unknown:uncultivated organism with predicted taxonomy: Fibrobacter
  REGION 1..162: note = MG16-219 RuvC-III domain
RQTQYISKKALEMLKEVCCKVYATNGSVTDFIRHTWGYDEILHQLNFDRYKQGGLTEVREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKR

SEQ ID NO: 3122 - protein, 163 aa, unidentified
  REGION 1..163: note = Description of Unknown:uncultivated organism with predicted taxonomy:Sediminibacterium sp. C3
  REGION 1..163: note = MG16-220 RuvC-III domain
RQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLNACRNEMLDELNSKDERVIDPERSMLEKWINSQPHICYAQAKDEVDKIIVSQRPNTR

SEQ ID NO: 3123 - protein, 163 aa, unidentified
  REGION 1..163: note = Description of Unknown:uncultivated organism with predicted taxonomy:Sediminibacterium sp. C3
  REGION 1..163: note = MG16-221 RuvC-III domain
RQSQYIAKKSVEMLQQVCKNVYTTSGSVTDFVRHQWGYDEILHDLNFERFKKAGLTAMVKQLHSGKEVEVERIMDWTKRLDNRHHAVDALTIACTTQGMIQRLNTLNASRDEMLEELNSKDQRVVDPERSMLEKWIFVQPHISYVEAKNEIDKIVISQRPNTR

SEQ ID NO: 3124 - protein, 163 aa, unidentified
  REGION 1..163: note = Description of Unknown:uncultivated organism with predicted taxonomy: Prevotella sp.ne3005
  REGION 1..163: note = MG16-222 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWVFVQPHISYSEAKNEIDKIVISQRPNTR

SEQ ID NO: 3125 - protein, 163 aa, unidentified
  REGION 1..163: note = Description of Unknown:uncultivated organism with predicted taxonomy: Prevotellacopri
  REGION 1..163: note = MG16-223 RuvC-III domain
RQSQYIAKKSVEILQQVCKNVYTTSGSVTDFVRHQWGYDEILHDLNFEHFKKANLTTMVKQLHSGKEVEVERIKDWTKRLDNRHHAVDALAIACTTQGMIQRLNTLNASRDAMLDELNNKEQRMIDSERSMLEKWIISQPHVSYAEAKKEIDKILISLRPNTR

SEQ ID NO: 3126 - protein, 135 aa, unidentified
  REGION 1..135: note = Description of Unknown:uncultivated organism with predicted taxonomy: Bacteroides sp.CAG:770
  REGION 1..135: note = MG16-224 RuvC-III domain
RQSQYIAKKSVEMLQQVCKNVYTTSGSVTDFVRHQWGYDELLHELNIERFKKAGLTAMVKQLHSGKEVEVERIKDWTKRLDNRHHAVDAFAIACTTQGMIQRLNTLNASRDEMFEELNTKDQRLIDPERSMLEKW

SEQ ID NO: 3127 - protein, 162 aa, unidentified
  REGION 1..162: note = Description of Unknown:uncultivated organism with predicted taxonomy: Bacteroidales
  REGION 1..162: note = MG16-225 RuvC-III domain
RQSQYISKKAVEILRSAIRDVYATSGSVTDFLRHIWGYDQILHNLNLPKYRDAELTEFVTYDHRGQEHQEERIKNWSKRIDHRHHAIDALTIALTRQGYIQRLNNLNASHDDIAEAVRKVNPLMEKKYSLLEKYIYIQPHFTVQEVTDKVDGILVSFRAGKK

SEQ ID NO: 3128 - protein, 20 aa, unidentified
  REGION 1..20: note = Description of Unknown:uncultivated organism
  REGION 1..20: note = MG16-226 RuvC-III domain
RLSQYIATKAVEILQQGIRQ

SEQ ID NO: 3129 - protein, 165 aa, unidentified
  REGION 1..165: note = Description of Unknown:uncultivated organism with predicted taxonomy: Bacteroidales
  REGION 1..165: note = MG16-228 RuvC-III domain
RQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKR

SEQ ID NO: 3130 - protein, 165 aa, unidentified; identical to SEQ ID NO: 3129
  REGION 1..165: note = Description of Unknown:uncultivated organism with predicted taxonomy: Bacteroidales
  REGION 1..165: note = MG16-229 RuvC-III domain

SEQ ID NO: 3131 - protein, 150 aa, unidentified
  REGION 1..150: note = Description of Unknown:uncultivated organism with predicted taxonomy: Bacteroides sp.CAG:545
  REGION 1..150: note = MG16-230 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEASDNVSRILVSFKAGKK

SEQ ID NO: 3132 - protein, 150 aa, unidentified
  REGION 1..150: note = Description of Unknown:uncultivated organism with predicted taxonomy: Bacteroides sp.CAG:770
  REGION 1..150: note = MG16-231 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNILNAKTAIGEEQMSLDKWTLAQAHFSVADVADHVADILVSFKSGKR

SEQ ID NO: 3133 - protein, 150 aa, unidentified
  REGION 1..150: note = Description of Unknown:uncultivated organism with predicted taxonomy: Bacteroides sp.CAG:770
  REGION 1..150: note = MG16-232 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLSQPHFSVQEVSDNVSRILVSFKAGKK

SEQ ID NO: 3134 - protein, 150 aa, unidentified; identical to SEQ ID NO: 2934
  REGION 1..150: note = Description of Unknown:uncultivated organism with predicted taxonomy: Bacteroides sp.CAG:545
  REGION 1..150: note = MG16-233 RuvC-III domain

SEQ ID NO: 3135 - protein, 150 aa, unidentified
  REGION 1..150: note = Description of Unknown:uncultivated organism with predicted taxonomy: Bacteroides sp.CAG:770
  REGION 1..150: note = MG16-234 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKR

SEQ ID NO: 3136 - protein, 150 aa, unidentified; identical to SEQ ID NO: 3135
  REGION 1..150: note = Description of Unknown:uncultivated organism with predicted taxonomy: Bacteroides sp.CAG:770
  REGION 1..150: note = MG16-235 RuvC-III domain

SEQ ID NO: 3137 - protein, 150 aa, unidentified
  REGION 1..150: note = Description of Unknown:uncultivated organism with predicted taxonomy: Bacteroides sp.CAG:770
  REGION 1..150: note = MG16-236 RuvC-III domain
VQTQYISRKAMEILNQVCRNVYGSSGDVTASLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 3138 - protein, 150 aa, unidentified; identical to SEQ ID NO: 2925
  REGION 1..150: note = Description of Unknown:uncultivated organism with predicted taxonomy: Bacteroides sp.CAG:770
  REGION 1..150: note = MG16-237 RuvC-III domain

SEQ ID NO: 3139 - protein, 150 aa, unidentified; identical to SEQ ID NO: 2925
  REGION 1..150: note = Description of Unknown:uncultivated organism with predicted taxonomy: Bacteroides sp.CAG:545
  REGION 1..150: note = MG16-238 RuvC-III domain

SEQ ID NO: 3140 - protein, 150 aa, unidentified; identical to SEQ ID NO: 2939
  REGION 1..150: note = Description of Unknown:uncultivated organism with predicted taxonomy: Bacteroides sp.CAG:770
  REGION 1..150: note = MG16-239 RuvC-III domain

SEQ ID NO: 3141 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-240 RuvC-III domain

SEQ ID NO: 3142 - protein, 150 aa, unidentified; identical to SEQ ID NO: 2939
  REGION 1..150: note = Description of Unknown:uncultivated organism with predicted taxonomy: Bacteroides sp.CAG:770
  REGION 1..150: note = MG16-242 RuvC-III domain

SEQ ID NO: 3143 - protein, 150 aa, unidentified; identical to SEQ ID NO: 2939
  REGION 1..150: note = Description of Unknown:uncultivated organism with predicted taxonomy: Bacteroides sp.CAG:709
  REGION 1..150: note = MG16-243 RuvC-III domain

SEQ ID NO: 3144 - protein, 163 aa, unidentified
  REGION 1..163: note = Description of Unknown:uncultivated organism with predicted taxonomy: Bacteroidales
  REGION 1..163: note = MG16-245 RuvC-III domain
RQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSILERWVADQPHFSVADVTNKVDGILVSFRAGKR

SEQ ID NO: 3145 - protein, 163 aa, unidentified
  REGION 1..163: note = Description of Unknown:uncultivated organism with predicted taxonomy: Bacteroides sp.CAG:770
  REGION 1..163: note = MG16-246 RuvC-III domain
RQSQYIARKSVEMLQQVCKDVYTTSGSVTDFVRHQWGYDEILHDLNFERFKKAGLTTMVTQLHSGKEVEVERIKDWTKRLDNRHHAVDALAIACTTQGMIQRLNTLNASREGILDELNSKEERVVDPERSMLEKWIYTQPHISYAQAKEAIDNIIISQRPNIR

SEQ ID NO: 3146 - protein, 163 aa, unidentified
  REGION 1..163: note = Description of Unknown:uncultivated organism with predicted taxonomy: Porphyromonassp. oral taxon 278
  REGION 1..163: note = MG16-247 RuvC-III domain
RQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKR

SEQ ID NO: 3147 - protein, 163 aa, unidentified
  REGION 1..163: note = Description of Unknown:uncultivated organism with predicted taxonomy: Coprobacter sp.
  REGION 1..163: note = MG16-248 RuvC-III domain
RQSQYIAVKAVEILQAGIRHVWTSGGSVTDFLRHQWGYDEILHTLNLPRYRKVDELTEIVHFEHAGQEHEEERIKNWTKRIDHRHHAIDALTVALTQQSYIQRLNTLEASHDWMEKQVKEVNTPYNEKKSVLERWIADQPHFSVSDVTDKVDGILVSFRAGKR

SEQ ID NO: 3148 - protein, 162 aa, unidentified; identical to SEQ ID NO: 3057
  REGION 1..162: note = Description of Unknown:uncultivated organism with predicted taxonomy: Bacteroides sp.CAG:144
  REGION 1..162: note = MG16-249 RuvC-III domain

SEQ ID NO: 3149 - protein, 163 aa, unidentified
  REGION 1..163: note = Description of Unknown:uncultivated organism with predicted taxonomy:Sediminibacterium sp. C3
  REGION 1..163: note = MG16-250 RuvC-III domain
RQSQYIAKKSVEMLQQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDVMLEELSSNDQRLVDPERSMLEKWIYVQPHISYAEAKNEVDKIVISQRPNTR

SEQ ID NO: 3150 - protein, 159 aa, unidentified
  REGION 1..159: note = Description of Unknown:uncultivated organism with predicted taxonomy: Bacteroides sp.CAG:144
  REGION 1..159: note = MG16-251 RuvC-III domain
RLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKK

SEQ ID NO: 3151 - protein, 162 aa, unidentified
  REGION 1..162: note = Description of Unknown:uncultivated organism with predicted taxonomy: Bacteroidales
  REGION 1..162: note = MG16-252 RuvC-III domain
RQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKK

SEQ ID NO: 3152 - protein, 159 aa, unidentified
  REGION 1..159: note = Description of Unknown:uncultivated organism
  REGION 1..159: note = MG16-253 RuvC-III domain
RLSQYISKKAQELLKAACREVMATSGSITDLIRHTWGYDTILHELNFPRYKDAGLTEIIKDEETGMQREVIPDWSKRLDHRHHAIDALAVACTSRSIVQRINTLNASREIIREEIKTSRKEWEDNDLLQQWIKEKMPFDRQYVVQKVASILVSMKAGKK

SEQ ID NO: 3153 - protein, 163 aa, unidentified
  REGION 1..163: note = Description of Unknown:uncultivated organism with predicted taxonomy:Marinilabiliaceae
  REGION 1..163: note = MG16-254 RuvC-III domain
RQSQYIAVKAVEVLQDGIRQVWTSGGSVTDFLRHQWGYDEILHTLNLPRYRQVEGLTELVDFEHAGQKHTEERIKNWSKRIDHRHHAIDALTVALTQQGYIQRLNTLEASHDFMEKQVKEAGTKYNEKKSILEKWINEQPHFSVEEVTNAVDRILVSFRAGKR

SEQ ID NO: 3154 - protein, 163 aa, unidentified
  REGION 1..163: note = Description of Unknown:uncultivated organism with predicted taxonomy: Bacteroidetes
  REGION 1..163: note = MG16-255 RuvC-III domain
RLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKH

SEQ ID NO: 3155 - protein, 159 aa, unidentified; identical to SEQ ID NO: 3150
  REGION 1..159: note = Description of Unknown:uncultivated organism with predicted taxonomy: Bacteroides sp.CAG:144
  REGION 1..159: note = MG16-256 RuvC-III domain

SEQ ID NO: 3156 - protein, 165 aa, unidentified
  REGION 1..165: note = Description of Unknown:uncultivated organism with predicted taxonomy: Bacteroidia
  REGION 1..165: note = MG16-257 RuvC-III domain
RQSQYIAVKAVEILQQGIRQVWTSGGSVTDFLRHLWGYDEILHTLNLPRYRQVEELTEIVHYEHAGQEHDEERIKNWSKRIDHRHHAIDALTVALTRQAYIQRLNSLNAEFTREEMLKEVEEANTVYNEKKSLLEKWVNEQPHFSVDDVTQSVDSILVSFRAGKR

SEQ ID NO: 3157 - protein, 163 aa, unidentified; identical to SEQ ID NO: 3146
  REGION 1..163: note = Description of Unknown:uncultivated organism with predicted taxonomy: Bacteroidales
  REGION 1..163: note = MG16-258 RuvC-III domain

SEQ ID NO: 3158 - protein, 162 aa, unidentified
  REGION 1..162: note = Description of Unknown:uncultivated organism with predicted taxonomy: Prevotellasaccharolytica
  REGION 1..162: note = MG16-259 RuvC-III domain
RQTQYIAKKALEMLKDVCYNVYATSGSVTDFIRHTWGYDEILHQLNYDRYKKGGLTEFREYDHKGETHTEERIQDWSKRLDHRHHAIDALVIAMTRQSIIQRLNHLNTERDAMFQEVEKQRKEWKNDYSMLQEWLRERKHFSAEDVAKKVSDILVSFKAGKR

SEQ ID NO: 3159 - protein, 163 aa, unidentified; identical to SEQ ID NO: 3154
  REGION 1..163: note = Description of Unknown:uncultivated organism with predicted taxonomy: Bacteroides sp.CAG:770
  REGION 1..163: note = MG16-260 RuvC-III domain

SEQ ID NO: 3160 - protein, 162 aa, unidentified
  REGION 1..162: note = Description of Unknown:uncultivated organism with predicted taxonomy: Bacteroidales
  REGION 1..162: note = MG16-261 RuvC-III domain
RQTQYISKKALELLREICHNVYATSGSVTDFIRHTWGYDEILHQLNFDRYKQSGLTEIREFDNKGEIHKEERIQKWNKRLDHRHHAIDALVIAMTKQSIIQRLNHLNTERDAMFQEVEKQSIEWKNDFSLLQEWLRERKHFSTKDVANRVANILISFKAGKR

SEQ ID NO: 3161 - protein, 120 aa, unidentified
  REGION 1..120: note = Description of Unknown:uncultivated organism with predicted taxonomy: Porphyromonascatoniae
  REGION 1..120: note = MG16-262 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDEMLEELNGK

SEQ ID NO: 3162 - protein, 163 aa, unidentified
  REGION 1..163: note = Description of Unknown:uncultivated organism with predicted taxonomy:Sediminibacterium sp. C3
  REGION 1..163: note = MG16-263 RuvC-III domain
RLSQYIAKKSVEMLQQVCRNVYSTSGSVTDFVRHQWGYDELLHDLNFERYKRAGLTAMVTQLRSGKEVEVERIKDWTKRLDNRHHAVDALAIACTTQGMIQRLNTLNASREDILDELNKTEERNDDSERSMLEKWICSQPHISYAEAKDELDKIIISQRPSTR

SEQ ID NO: 3163 - protein, 166 aa, unidentified
  REGION 1..166: note = Description of Unknown:uncultivated organism
  REGION 1..166: note = MG16-264 RuvC-III domain
GETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKK

SEQ ID NO: 3164 - protein, 163 aa, unidentified
  REGION 1..163: note = Description of Unknown:uncultivated organism
  REGION 1..163: note = MG16-265 RuvC-III domain
RQSQYIAKKSVEMLQLVCRNVYTTSGSVTETVRRLWGYNELLHDLNFERFKKAGLTTMVTQLHSGEEIEVERIKDWTKRLDNRHHAVDALAIACTTQGMIQRLNTLNASRDDMLKELNSQEQRVVDPEHSMLEKWIYTQPHISYVQAKEAIEKIIISQRPNTR

SEQ ID NO: 3165 - protein, 162 aa, unidentified; identical to SEQ ID NO: 3095
  REGION 1..162: note = Description of Unknown:uncultivated organism with predicted taxonomy: Porphyromonassp. oral taxon 278
  REGION 1..162: note = MG16-266 RuvC-III domain

SEQ ID NO: 3166 - protein, 163 aa, unidentified
  REGION 1..163: note = Description of Unknown:uncultivated organism
  REGION 1..163: note = MG16-267 RuvC-III domain
RQSQYIAKKSVEMLLQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3167 - protein, 163 aa, unidentified
  REGION 1..163: note = Description of Unknown:uncultivated organism with predicted taxonomy: Prevotella
  REGION 1..163: note = MG16-268 RuvC-III domain
SLSQYISRKAMEILQTGCRKVYATSGSITDIERHLWGYDTILHELNFPRYKCAGLTTVIKEEYEEGIITEKEVITNWSKRKDNRHHAIDALVIACTTQDTIQRINTLHASRDELQKETSGNPVFYSEKSTLLERWIKGKQPIPRHEVLEQVKQIAISIKAGKK

SEQ ID NO: 3168 - protein, 163 aa, unidentified; identical to SEQ ID NO: 3118
  REGION 1..163: note = Description of Unknown:uncultivated organism with predicted taxonomy: Bacteroidales
  REGION 1..163: note = MG16-269 RuvC-III domain

SEQ ID NO: 3169 - protein, 163 aa, unidentified
  REGION 1..163: note = Description of Unknown:uncultivated organism with predicted taxonomy: Bacteroidales
  REGION 1..163: note = MG16-270 RuvC-III domain
RQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSVLERWVADQPHFSVADVTDKVDGILVSFRAGKR

SEQ ID NO: 3170 - protein, 164 aa, unidentified
  REGION 1..164: note = Description of Unknown:uncultivated organism with predicted taxonomy: Bacteroidales
  REGION 1..164: note = MG16-271 RuvC-III domain
RQSQYIAAKAVEILQTAIRDVHATSGSVTELLRHQWGYDEILHHLNLPRYNKADLTEIVQYDHAGQKHTVERIKNWNKRLDQRHHAVDALTIALTKQSYIQRLNTLNASRETIYNEVEQADAKLRNEEKRTLLENWVAIQPHFPVKDVEDKVAGILVSFRAGKR

SEQ ID NO: 3171 - protein, 163 aa, unidentified
  REGION 1..163: note = Description of Unknown:uncultivated organism with predicted taxonomy: Bacteroides sp.CAG:770
  REGION 1..163: note = MG16-272 RuvC-III domain
RQSQYIAKKSVEMLQQVCKNVYTTSGSVTDFVRHQWGYDELLHELNFERFKKAGLTAMVKQLHSGKEIEVERIKDWTKRLDNRHHAVDALAIACTTQGMIQRLNTLNASRDEMQEELSSKEQRLVDPERSMLEKWIFAQPHISYAEAKNEIDKIIISQRPNTR

SEQ ID NO: 3172 - protein, 163 aa, unidentified
  REGION 1..163: note = Description of Unknown:uncultivated organism with predicted taxonomy: Bacteroidetes
  REGION 1..163: note = MG16-273 RuvC-III domain
RLSQYIAKKSVEMLQQVCKNVYATSGSITDFVRHQWGYDELLHDLNFERFKKAGLTTMVKQLHSGEEVEVERIANWTKRLDNRHHAVDALAIACTTQSMIQRLNTLNASRDDMLEEQNSKDQRLVDPERSMLEKWVFIQPHITYADAKKEIDKIVISQRPNTR

SEQ ID NO: 3173 - protein, 159 aa, unidentified
  REGION 1..159: note = Description of Unknown:uncultivated organism with predicted taxonomy: Bacteroidales
  REGION 1..159: note = MG16-274 RuvC-III domain
RLSQYISKKAQELLKTACREVMATSGSITDLIRHTWGYDTILHELNFPRYKDAGLTEIIKDEETGMQRELIPDWSKRLDHRHHAIDALAVACTSRSIVQRINTLHASREIIRDEIKTSRKEWEDNDLLQQWIKEKMPFDRQYVVQKVASILVSMKAGKK

SEQ ID NO: 3174 - protein, 166 aa, unidentified; identical to SEQ ID NO: 3163
  REGION 1..166: note = Description of Unknown:uncultivated organism with predicted taxonomy: Bacteroidetes
  REGION 1..166: note = MG16-275 RuvC-III domain

SEQ ID NO: 3175 - protein, 134 aa, unidentified
  REGION 1..134: note = Description of Unknown:uncultivated organism with predicted taxonomy: Clostridiales
  REGION 1..134: note = MG18-1 RuvC-III domain
VETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGR

SEQ ID NO: 3176 - protein, 136 aa, unidentified
  REGION 1..136: note = Description of Unknown:uncultivated organism with predicted taxonomy:Phascolarctobacterium succinatutens
  REGION 1..136: note = MG18-3 RuvC-III domain
VETRQSTKAVATILKTAYKHSEVVYVKAGNVSDFRHQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGK

SEQ ID NO: 3177 - protein, 136 aa, unidentified
  REGION 1..136: note = Description of Unknown:uncultivated organism with predicted taxonomy:Phascolarctobacterium succinatutens
  REGION 1..136: note = MG18-4 RuvC-III domain
VETRQSTKAVATILKTAYKHSEIVYVKAGNVSDFRQKFEFVKCRDVNDLHHAKDAYLNIVVGNCYHVKFTDKPMDFIKKNQDNRSYSLKPEIFYKFSIKRDSEIAWVGGKDGTITTVTKTMHKNNILFTRQPVEGK

SEQ ID NO: 3178 - protein, 136 aa, unidentified
  REGION 1..136: note = Description of Unknown:uncultivated organism with predicted taxonomy:Phascolarctobacterium succinatutens
  REGION 1..136: note = MG18-5 RuvC-III domain
VETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGK

SEQ ID NO: 3179 - protein, 136 aa, unidentified
  REGION 1..136: note = Description of Unknown:uncultivated organism with predicted taxonomy:Phascolarctobacterium
  REGION 1..136: note = MG18-6 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGEDGTMAIVARTMHKNNILFTRQAVEGK

SEQ ID NO: 3180 - protein, 136 aa, unidentified
  REGION 1..136: note = Description of Unknown:uncultivated organism with predicted taxonomy:Acidaminococcales
  REGION 1..136: note = MG18-7 RuvC-III domain
VETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGK

SEQ ID NO: 3181 - protein, 136 aa, unidentified
  REGION 1..136: note = Description of Unknown:uncultivated organism
  REGION 1..136: note = MG18-8 RuvC-III domain
VETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGK

SEQ ID NO: 3182 - protein, 136 aa, unidentified
  REGION 1..136: note = Description of Unknown:uncultivated organism with predicted taxonomy:Phascolarctobacterium succinatutens
  REGION 1..136: note = MG18-9 RuvC-III domain
VETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3183 - protein, 136 aa, unidentified; identical to SEQ ID NO: 3182
  REGION 1..136: note = Description of Unknown:uncultivated organism with predicted taxonomy:Phascolarctobacterium
  REGION 1..136: note = MG18-10 RuvC-III domain

SEQ ID NO: 3184 - protein, 136 aa, unidentified
  REGION 1..136: note = Description of Unknown:uncultivated organism with predicted taxonomy:Phascolarctobacterium succinatutens
  REGION 1..136: note = MG18-11 RuvC-III domain
VETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3185 - protein, 136 aa, unidentified
  REGION 1..136: note = Description of Unknown:uncultivated organism with predicted taxonomy:Phascolarctobacterium succinatutens
  REGION 1..136: note = MG18-12 RuvC-III domain
VETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGK

SEQ ID NO: 3186 - protein, 136 aa, unidentified; identical to SEQ ID NO: 3177
  REGION 1..136: note = Description of Unknown:uncultivated organism with predicted taxonomy:Phascolarctobacterium succinatutens
  REGION 1..136: note = MG18-13 RuvC-III domain

SEQ ID NO: 3187 - protein, 136 aa, unidentified; identical to SEQ ID NO: 3182
  REGION 1..136: note = Description of Unknown:uncultivated organism with predicted taxonomy:Phascolarctobacterium
  REGION 1..136: note = MG18-14 RuvC-III domain

SEQ ID NO: 3188 - protein, 136 aa, unidentified
  REGION 1..136: note = Description of Unknown:uncultivated organism with predicted taxonomy:Phascolarctobacterium succinatutens
  REGION 1..136: note = MG18-15 RuvC-III domain
VETRQSTKAVAAILKTAYQNSEVVYVKAGNVSDFRQQFKFEKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3189 - protein, 136 aa, unidentified; identical to SEQ ID NO: 3185
  REGION 1..136: note = Description of Unknown:uncultivated organism with predicted taxonomy:Phascolarctobacterium succinatutens
  REGION 1..136: note = MG18-16 RuvC-III domain

SEQ ID NO: 3190 - protein, 136 aa, unidentified; identical to SEQ ID NO: 3182
  REGION 1..136: note = Description of Unknown:uncultivated organism with predicted taxonomy:Phascolarctobacterium
  REGION 1..136: note = MG18-17 RuvC-III domain

SEQ ID NO: 3191 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-18 RuvC-III domain

SEQ ID NO: 3192 - protein, 136 aa, unidentified; identical to SEQ ID NO: 3182
  REGION 1..136: note = Description of Unknown:uncultivated organism with predicted taxonomy:Phascolarctobacterium
  REGION 1..136: note = MG18-19 RuvC-III domain

SEQ ID NO: 3193 - protein, 136 aa, unidentified; identical to SEQ ID NO: 3182
  REGION 1..136: note = Description of Unknown:uncultivated organism with predicted taxonomy:Phascolarctobacterium
  REGION 1..136: note = MG18-20 RuvC-III domain

SEQ ID NO: 3194 - protein, 136 aa, unidentified; identical to SEQ ID NO: 3182
  REGION 1..136: note = Description of Unknown:uncultivated organism with predicted taxonomy:Phascolarctobacterium
  REGION 1..136: note = MG18-21 RuvC-III domain

SEQ ID NO: 3195 - protein, 136 aa, unidentified; identical to SEQ ID NO: 3177
  REGION 1..136: note = Description of Unknown:uncultivated organism with predicted taxonomy:Phascolarctobacterium
  REGION 1..136: note = MG18-22 RuvC-III domain

SEQ ID NO: 3196 - protein, 136 aa, unidentified
  REGION 1..136: note = Description of Unknown:uncultivated organism with predicted taxonomy:Phascolarctobacterium succinatutens
  REGION 1..136: note = MG18-23 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVVRTMHKNNILFTRQAVEGK

SEQ ID NO: 3197 - protein, 136 aa, unidentified
  REGION 1..136: note = Description of Unknown:uncultivated organism with predicted taxonomy:Phascolarctobacterium
  REGION 1..136: note = MG18-24 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3198 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-25 RuvC-III domain

SEQ ID NO: 3199 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-26 RuvC-III domain

SEQ ID NO: 3200 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-27 RuvC-III domain

SEQ ID NO: 3201 - protein, 136 aa, unidentified
  REGION 1..136: note = Description of Unknown:uncultivated organism with predicted taxonomy:Phascolarctobacterium
  REGION 1..136: note = MG18-28 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3202 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-29 RuvC-III domain

SEQ ID NO: 3203 - protein, 136 aa, unidentified
  REGION 1..136: note = Description of Unknown:uncultivated organism with predicted taxonomy:Phascolarctobacterium succinatutens
  REGION 1..136: note = MG18-30 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3204 - protein, 136 aa, unidentified; identical to SEQ ID NO: 3203
  REGION 1..136: note = Description of Unknown:uncultivated organism with predicted taxonomy:Phascolarctobacterium succinatutens
  REGION 1..136: note = MG18-31 RuvC-III domain

SEQ ID NO: 3205 - protein, 136 aa, unidentified
  REGION 1..136: note = Description of Unknown:uncultivated organism with predicted taxonomy:Phascolarctobacterium succinatutens
  REGION 1..136: note = MG18-32 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3206 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-33 RuvC-III domain

SEQ ID NO: 3207 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-34 RuvC-III domain

SEQ ID NO: 3208 - protein, 136 aa, unidentified; identical to SEQ ID NO: 3185
  REGION 1..136: note = Description of Unknown:uncultivated organism with predicted taxonomy:Phascolarctobacterium succinatutens
  REGION 1..136: note = MG18-35 RuvC-III domain

SEQ ID NO: 3209 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-36 RuvC-III domain

SEQ ID NO: 3210 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-37 RuvC-III domain

SEQ ID NO: 3211 - protein, 136 aa, unidentified; identical to SEQ ID NO: 3203
  REGION 1..136: note = Description of Unknown:uncultivated organism with predicted taxonomy:Phascolarctobacterium
  REGION 1..136: note = MG18-38 RuvC-III domain

SEQ ID NO: 3212 - protein, 136 aa, unidentified; identical to SEQ ID NO: 3205
  REGION 1..136: note = Description of Unknown:uncultivated organism with predicted taxonomy:Phascolarctobacterium
  REGION 1..136: note = MG18-39 RuvC-III domain

SEQ ID NO: 3213 - protein, 136 aa, unidentified
  REGION 1..136: note = Description of Unknown:uncultivated organism with predicted taxonomy:Phascolarctobacterium succinatutens
  REGION 1..136: note = MG18-40 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGK

SEQ ID NO: 3214 - protein, 136 aa, unidentified
  REGION 1..136: note = Description of Unknown:uncultivated organism with predicted taxonomy:Phascolarctobacterium succinatutens
  REGION 1..136: note = MG18-41 RuvC-III domain
VETRQSTKAVAAILKTAYQNSEVVYVKAGNVSDFRQQFKFVKCRDVNDLHHAKDAYLNIVVGNCYHVKFTAHPLNFITKNQDNRRYSLKPEIFYKFSIKRDGEIAWLGGEDGTMATVARTMHKNNILFTRQAVEGK

SEQ ID NO: 3215 - protein, 136 aa, unidentified; identical to SEQ ID NO: 3176
  REGION 1..136: note = Description of Unknown:uncultivated organism with predicted taxonomy:Phascolarctobacterium succinatutens
  REGION 1..136: note = MG18-42 RuvC-III domain

SEQ ID NO: 3216 - protein, 136 aa, unidentified; identical to SEQ ID NO: 3185
  REGION 1..136: note = Description of Unknown:uncultivated organism with predicted taxonomy:Phascolarctobacterium succinatutens
  REGION 1..136: note = MG18-43 RuvC-III domain

SEQ ID NO: 3217 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-44 RuvC-III domain

SEQ ID NO: 3218 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-45 RuvC-III domain

SEQ ID NO: 3219 - protein, 136 aa, unidentified
  REGION 1..136: note = Description of Unknown:uncultivated organism with predicted taxonomy:Phascolarctobacterium
  REGION 1..136: note = MG18-46 RuvC-III domain
VETRQSTKAVAAILKTAYQNSEVVYVKAGNVSDFRQQFKFVKCREVNDLHHAKDAYLNIVVGNCYHVKFTANHLNFITKNQDNRRYSLKPEIFYKFSIKRDGEIAWLGGEDGTMATVARTMHKNNILFTRQAVEGK

SEQ ID NO: 3220 - protein, 136 aa, unidentified; identical to SEQ ID NO: 3180
  REGION 1..136: note = Description of Unknown:uncultivated organism with predicted taxonomy:Phascolarctobacterium
  REGION 1..136: note = MG18-47 RuvC-III domain

SEQ ID NO: 3221 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-48 RuvC-III domain

SEQ ID NO: 3222 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-49 RuvC-III domain

SEQ ID NO: 3223 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-50 RuvC-III domain

SEQ ID NO: 3224 - protein, 136 aa, unidentified
  REGION 1..136: note = Description of Unknown:uncultivated organism with predicted taxonomy:Phascolarctobacterium succinatutens
  REGION 1..136: note = MG18-51 RuvC-III domain
VETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3225 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-52 RuvC-III domain

SEQ ID NO: 3226 - protein, 136 aa, unidentified; identical to SEQ ID NO: 3203
  REGION 1..136: note = Description of Unknown:uncultivated organism with predicted taxonomy: Firmicutes
  REGION 1..136: note = MG18-53 RuvC-III domain

SEQ ID NO: 3227 - protein, 136 aa, unidentified
  REGION 1..136: note = Description of Unknown:uncultivated organism with predicted taxonomy:Phascolarctobacterium
  REGION 1..136: note = MG18-54 RuvC-III domain
VETRQSTKAVATILKTAYKHSEIVYVKAGNVSDFRQKFEFVKCRDVNDLHHAKNAYLNIVVGNCYYVKFTAKPLDFIKKNQDNRSYSLKPEIFYKFSIKRDSEIAWVGGKDGTITTVTKTIHKNNILFTRQPVEGK

SEQ ID NO: 3228 - protein, 136 aa, unidentified; identical to SEQ ID NO: 3197
  REGION 1..136: note = Description of Unknown:uncultivated organism with predicted taxonomy:Phascolarctobacterium
  REGION 1..136: note = MG18-55 RuvC-III domain

SEQ ID NO: 3229 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-56 RuvC-III domain

SEQ ID NO: 3230 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-57 RuvC-III domain

SEQ ID NO: 3231 - protein, 136 aa, unidentified
  REGION 1..136: note = Description of Unknown:uncultivated organism with predicted taxonomy:Phascolarctobacterium succinatutens
  REGION 1..136: note = MG18-58 RuvC-III domain
VETRQSTKAVAAILKTAYQNSEVVYVKAGNVSDFRQQFKFVKCREVNDLHHAKDAYLNIVVGNCHHVKFTANPLNFITKNQDNRRYSLKPEIFYKFSIKRDGEIAWLGGEDGTMATVARTMHKNNILFTRQAVEGK

SEQ ID NO: 3232 - protein, 136 aa, unidentified; identical to SEQ ID NO: 3203
  REGION 1..136: note = Description of Unknown:uncultivated organism with predicted taxonomy:Phascolarctobacterium succinatutens
  REGION 1..136: note = MG18-59 RuvC-III domain

SEQ ID NO: 3233 - protein, 136 aa, unidentified; identical to SEQ ID NO: 3197
  REGION 1..136: note = Description of Unknown:uncultivated organism
  REGION 1..136: note = MG18-60 RuvC-III domain

SEQ ID NO: 3234 - protein, 136 aa, unidentified
  REGION 1..136: note = Description of Unknown:uncultivated organism with predicted taxonomy:Phascolarctobacterium succinatutens
  REGION 1..136: note = MG18-61 RuvC-III domain
VETRQSTKAVAAILKTAYQNSEVVYVKAGNVSDFRQQFKFVKCRELNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3235 - protein, 136 aa, unidentified; identical to SEQ ID NO: 3185
  REGION 1..136: note = Description of Unknown:uncultivated organism with predicted taxonomy:Phascolarctobacterium succinatutens
  REGION 1..136: note = MG18-62 RuvC-III domain

SEQ ID NO: 3236 - protein, 136 aa, unidentified; identical to SEQ ID NO: 3197
  REGION 1..136: note = Description of Unknown:uncultivated organism
  REGION 1..136: note = MG18-63 RuvC-III domain

SEQ ID NO: 3237 - protein, 136 aa, unidentified
  REGION 1..136: note = Description of Unknown:uncultivated organism with predicted taxonomy:Phascolarctobacterium succinatutens
  REGION 1..136: note = MG18-64 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3238 - protein, 136 aa, unidentified; identical to SEQ ID NO: 3213
  REGION 1..136: note = Description of Unknown:uncultivated organism with predicted taxonomy: Firmicutes
  REGION 1..136: note = MG18-65 RuvC-III domain

SEQ ID NO: 3239 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-66 RuvC-III domain

SEQ ID NO: 3240 - protein, 136 aa, unidentified; identical to SEQ ID NO: 3184
  REGION 1..136: note = Description of Unknown:uncultivated organism
  REGION 1..136: note = MG18-67 RuvC-III domain

SEQ ID NO: 3241 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-68 RuvC-III domain

SEQ ID NO: 3242 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-69 RuvC-III domain

SEQ ID NO: 3243 - protein, 136 aa, unidentified; identical to SEQ ID NO: 3181
  REGION 1..136: note = Description of Unknown:uncultivated organism with predicted taxonomy: Negativicutes
  REGION 1..136: note = MG18-70 RuvC-III domain

SEQ ID NO: 3244 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-71 RuvC-III domain

SEQ ID NO: 3245 - protein, 136 aa, unidentified; identical to SEQ ID NO: 3213
  REGION 1..136: note = Description of Unknown:uncultivated organism with predicted taxonomy:Phascolarctobacterium succinatutens
  REGION 1..136: note = MG18-72 RuvC-III domain

SEQ ID NO: 3246 - protein, 136 aa, unidentified; identical to SEQ ID NO: 3224
  REGION 1..136: note = Description of Unknown:uncultivated organism with predicted taxonomy:Phascolarctobacterium
  REGION 1..136: note = MG18-73 RuvC-III domain

SEQ ID NO: 3247 - protein, 136 aa, unidentified
  REGION 1..136: note = Description of Unknown:uncultivated organism with predicted taxonomy:Phascolarctobacterium succinatutens
  REGION 1..136: note = MG18-74 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQAVEGK

SEQ ID NO: 3248 - protein, 136 aa, unidentified; identical to SEQ ID NO: 3179
  REGION 1..136: note = Description of Unknown:uncultivated organism with predicted taxonomy:Phascolarctobacterium
  REGION 1..136: note = MG18-75 RuvC-III domain

SEQ ID NO: 3249 - protein, 136 aa, unidentified; identical to SEQ ID NO: 3178
  REGION 1..136: note = Description of Unknown:uncultivated organism with predicted taxonomy:Phascolarctobacterium succinatutens
  REGION 1..136: note = MG18-76 RuvC-III domain

SEQ ID NO: 3250 - protein, 136 aa, unidentified; identical to SEQ ID NO: 3197
  REGION 1..136: note = Description of Unknown:uncultivated organism with predicted taxonomy:Phascolarctobacterium
  REGION 1..136: note = MG18-78 RuvC-III domain

SEQ ID NO: 3251 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-79 RuvC-III domain

SEQ ID NO: 3252 - protein, 136 aa, unidentified; identical to SEQ ID NO: 3196
  REGION 1..136: note = Description of Unknown:uncultivated organism with predicted taxonomy:Phascolarctobacterium succinatutens
  REGION 1..136: note = MG18-80 RuvC-III domain

SEQ ID NO: 3253 - protein, 136 aa, unidentified; identical to SEQ ID NO: 3180
  REGION 1..136: note = Description of Unknown:uncultivated organism with predicted taxonomy:Phascolarctobacterium succinatutens
  REGION 1..136: note = MG18-81 RuvC-III domain

SEQ ID NO: 3254 - protein, 136 aa, unidentified; identical to SEQ ID NO: 3185
  REGION 1..136: note = Description of Unknown:uncultivated organism with predicted taxonomy:Phascolarctobacterium succinatutens
  REGION 1..136: note = MG18-82 RuvC-III domain

SEQ ID NO: 3255 - protein, 136 aa, unidentified; identical to SEQ ID NO: 3201
  REGION 1..136: note = Description of Unknown:uncultivated organism with predicted taxonomy:Phascolarctobacterium succinatutens
  REGION 1..136: note = MG18-83 RuvC-III domain

SEQ ID NO: 3256 - protein, 136 aa, unidentified; identical to SEQ ID NO: 3185
  REGION 1..136: note = Description of Unknown:uncultivated organism with predicted taxonomy:Phascolarctobacterium succinatutens
  REGION 1..136: note = MG18-84 RuvC-III domain

SEQ ID NO: 3257 - protein, 136 aa, unidentified; identical to SEQ ID NO: 3197
  REGION 1..136: note = Description of Unknown:uncultivated organism with predicted taxonomy:Phascolarctobacterium
  REGION 1..136: note = MG18-85 RuvC-III domain

SEQ ID NO: 3258 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-86 RuvC-III domain

SEQ ID NO: 3259 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-87 RuvC-III domain

SEQ ID NO: 3260 - protein, 136 aa, unidentified; identical to SEQ ID NO: 3179
  REGION 1..136: note = Description of Unknown:uncultivated organism with predicted taxonomy:Phascolarctobacterium
  REGION 1..136: note = MG18-88 RuvC-III domain

SEQ ID NO: 3261 - protein, 136 aa, unidentified
  REGION 1..136: note = Description of Unknown:uncultivated organism with predicted taxonomy: Firmicutes
  REGION 1..136: note = MG18-89 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMETVARTMHKNNILFTRQAVEGK

SEQ ID NO: 3262 - protein, 136 aa, unidentified; identical to SEQ ID NO: 3205
  REGION 1..136: note = Description of Unknown:uncultivated organism with predicted taxonomy:Phascolarctobacterium
  REGION 1..136: note = MG18-90 RuvC-III domain

SEQ ID NO: 3263 - protein, 136 aa, unidentified
  REGION 1..136: note = Description of Unknown:uncultivated organism with predicted taxonomy:Phascolarctobacterium succinatutens
  REGION 1..136: note = MG18-91 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGADGTMATVARTMHKNNILFTRQPLEGK

SEQ ID NO: 3264 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-92 RuvC-III domain

SEQ ID NO: 3265 - protein, 136 aa, unidentified
  REGION 1..136: note = Description of Unknown:uncultivated organism
  REGION 1..136: note = MG18-93 RuvC-III domain
VEMRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGK

SEQ ID NO: 3266 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-94 RuvC-III domain

SEQ ID NO: 3267 - protein, 136 aa, unidentified; identical to SEQ ID NO: 3213
  REGION 1..136: note = Description of Unknown:uncultivated organism
  REGION 1..136: note = MG18-95 RuvC-III domain

SEQ ID NO: 3268 - protein, 136 aa, unidentified; identical to SEQ ID NO: 3197
  REGION 1..136: note = Description of Unknown:uncultivated organism with predicted taxonomy: Clostridium sp.CAG:964
  REGION 1..136: note = MG18-96 RuvC-III domain

SEQ ID NO: 3269 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-97 RuvC-III domain

SEQ ID NO: 3270 - protein, 136 aa, unidentified
  REGION 1..136: note = Description of Unknown:uncultivated organism with predicted taxonomy:Phascolarctobacterium succinatutens
  REGION 1..136: note = MG18-98 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEFFYKFNIKRDDDIAWLGGADGTMATVARTMHKNNILFTRQPLEGK

SEQ ID NO: 3271 - protein, 136 aa, unidentified; identical to SEQ ID NO: 3178
  REGION 1..136: note = Description of Unknown:uncultivated organism with predicted taxonomy: Firmicutes
  REGION 1..136: note = MG18-99 RuvC-III domain

SEQ ID NO: 3272 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-100 RuvC-III domain

SEQ ID NO: 3273 - protein, 136 aa, unidentified; identical to SEQ ID NO: 3203
  REGION 1..136: note = Description of Unknown:uncultivated organism with predicted taxonomy: Firmicutes
  REGION 1..136: note = MG18-101 RuvC-III domain

SEQ ID NO: 3274 - protein, 136 aa, unidentified; identical to SEQ ID NO: 3237
  REGION 1..136: note = Description of Unknown:uncultivated organism with predicted taxonomy: Firmicutes
  REGION 1..136: note = MG18-102 RuvC-III domain

SEQ ID NO: 3275 - protein, 136 aa, unidentified
  REGION 1..136: note = Description of Unknown:uncultivated organism with predicted taxonomy:Phascolarctobacterium succinatutens
  REGION 1..136: note = MG18-103 RuvC-III domain
VETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQAVEGK

SEQ ID NO: 3276 - protein, 136 aa, unidentified; identical to SEQ ID NO: 3197
  REGION 1..136: note = Description of Unknown:uncultivated organism with predicted taxonomy:Phascolarctobacterium
  REGION 1..136: note = MG18-104 RuvC-III domain

SEQ ID NO: 3277 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-105 RuvC-III domain

SEQ ID NO: 3278 - protein, 136 aa, unidentified; identical to SEQ ID NO: 3182
  REGION 1..136: note = Description of Unknown:uncultivated organism with predicted taxonomy: Firmicutes
  REGION 1..136: note = MG18-106 RuvC-III domain

SEQ ID NO: 3279 - protein, 136 aa, unidentified
  REGION 1..136: note = Description of Unknown:uncultivated organism with predicted taxonomy:Phascolarctobacterium succinatutens
  REGION 1..136: note = MG18-107 RuvC-III domain
VETRQSTKAVAAILKTAYQNSAVVYVKAGNVSDFRQQFKFVKCREVNDLHHAKDAYLNIVVGNCYHVKFTASPLNFITKNQDNRRYSLKPEIFYKFSIKRDGEIAWLGGEDGTMATVARTMHKNNILFTRQAVEGK

SEQ ID NO: 3280 - protein, 136 aa, unidentified; identical to SEQ ID NO: 3203
  REGION 1..136: note = Description of Unknown:uncultivated organism with predicted taxonomy: Ruminococcaceaebacterium
  REGION 1..136: note = MG18-108 RuvC-III domain

SEQ ID NO: 3281 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-109 RuvC-III domain

SEQ ID NO: 3282 - protein, 136 aa, unidentified; identical to SEQ ID NO: 3178
  REGION 1..136: note = Description of Unknown:uncultivated organism with predicted taxonomy:Phascolarctobacterium succinatutens
  REGION 1..136: note = MG18-111 RuvC-III domain

SEQ ID NO: 3283 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-112 RuvC-III domain

SEQ ID NO: 3284 - protein, 136 aa, unidentified
  REGION 1..136: note = Description of Unknown:uncultivated organism with predicted taxonomy: Clostridiales
  REGION 1..136: note = MG18-113 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGK

SEQ ID NO: 3285 - protein, 136 aa, unidentified
  REGION 1..136: note = Description of Unknown:uncultivated organism with predicted taxonomy:Phascolarctobacterium
  REGION 1..136: note = MG18-114 RuvC-III domain
VETRQSTKAVAAILKTAYQNSEVVYVKAGNVSDFRQQFKFVKCREVNDLHHAKDAYQNIVVGNCYHVKFTANPLNFITKNQDNRRYSLKPEIFYKFSIKRDGEIAWLGGEDGTMATVARTMHKNNILFTRQAVEGK

SEQ ID NO: 3286 - protein, 136 aa, unidentified; identical to SEQ ID NO: 3224
  REGION 1..136: note = Description of Unknown:uncultivated organism with predicted taxonomy:Phascolarctobacterium succinatutens
  REGION 1..136: note = MG18-115 RuvC-III domain

SEQ ID NO: 3287 - protein, 136 aa, unidentified
  REGION 1..136: note = Description of Unknown:uncultivated organism with predicted taxonomy:Phascolarctobacterium succinatutens
  REGION 1..136: note = MG18-116 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFNIKRDDDIAWLGGEDGTMATVARTMHKNNILFTRQAVEGK

SEQ ID NO: 3288 - protein, 136 aa, unidentified; identical to SEQ ID NO: 3197
  REGION 1..136: note = Description of Unknown:uncultivated organism with predicted taxonomy:Phascolarctobacterium
  REGION 1..136: note = MG18-117 RuvC-III domain

SEQ ID NO: 3289 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-118 RuvC-III domain

SEQ ID NO: 3290 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-119 RuvC-III domain

SEQ ID NO: 3291 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-120 RuvC-III domain

SEQ ID NO: 3292 - protein, 136 aa, unidentified; identical to SEQ ID NO: 3224
  REGION 1..136: note = Description of Unknown:uncultivated organism with predicted taxonomy:Phascolarctobacterium succinatutens
  REGION 1..136: note = MG18-121 RuvC-III domain

SEQ ID NO: 3293 - protein, 136 aa, unidentified; identical to SEQ ID NO: 3203
  REGION 1..136: note = Description of Unknown:uncultivated organism with predicted taxonomy:Phascolarctobacterium
  REGION 1..136: note = MG18-122 RuvC-III domain

SEQ ID NO: 3294 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-123 RuvC-III domain

SEQ ID NO: 3295 - protein, 136 aa, unidentified; identical to SEQ ID NO: 3284
  REGION 1..136: note = Description of Unknown:uncultivated organism with predicted taxonomy:Phascolarctobacterium succinatutens
  REGION 1..136: note = MG18-124 RuvC-III domain

SEQ ID NO: 3296 - protein, 136 aa, unidentified; identical to SEQ ID NO: 3205
  REGION 1..136: note = Description of Unknown:uncultivated organism with predicted taxonomy:Phascolarctobacterium
  REGION 1..136: note = MG18-125 RuvC-III domain

SEQ ID NO: 3297 - protein, 136 aa, unidentified; identical to SEQ ID NO: 3284
  REGION 1..136: note = Description of Unknown:uncultivated organism with predicted taxonomy:Phascolarctobacterium
  REGION 1..136: note = MG18-126 RuvC-III domain

SEQ ID NO: 3298 - protein, 136 aa, unidentified; identical to SEQ ID NO: 3185
  REGION 1..136: note = Description of Unknown:uncultivated organism with predicted taxonomy:Phascolarctobacterium
  REGION 1..136: note = MG18-127 RuvC-III domain

SEQ ID NO: 3299 - protein, 136 aa, unidentified; identical to SEQ ID NO: 3197
  REGION 1..136: note = Description of Unknown:uncultivated organism with predicted taxonomy:Phascolarctobacterium
  REGION 1..136: note = MG18-128 RuvC-III domain

SEQ ID NO: 3300 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-129 RuvC-III domain

SEQ ID NO: 3301 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-130 RuvC-III domain

SEQ ID NO: 3302 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-131 RuvC-III domain

SEQ ID NO: 3303 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-132 RuvC-III domain

SEQ ID NO: 3304 - protein, 136 aa, unidentified; identical to SEQ ID NO: 3203
  REGION 1..136: note = Description of Unknown:uncultivated organism with predicted taxonomy:Phascolarctobacterium succinatutens
  REGION 1..136: note = MG18-133 RuvC-III domain

SEQ ID NO: 3305 - protein, 134 aa, unidentified; identical to SEQ ID NO: 3175
  REGION 1..134: note = Description of Unknown:uncultivated organism with predicted taxonomy: Clostridiales
  REGION 1..134: note = MG18-135 RuvC-III domain

SEQ ID NO: 3306 - protein, 134 aa, unidentified; identical to SEQ ID NO: 3175
  REGION 1..134: note = Description of Unknown:uncultivated organism with predicted taxonomy: Clostridiales
  REGION 1..134: note = MG18-136 RuvC-III domain

SEQ ID NO: 3307 - protein, 134 aa, unidentified; identical to SEQ ID NO: 3175
  REGION 1..134: note = Description of Unknown:uncultivated organism with predicted taxonomy: Dorea sp.OM02-2LB
  REGION 1..134: note = MG18-137 RuvC-III domain

SEQ ID NO: 3308 - protein, 136 aa, unidentified; identical to SEQ ID NO: 3197
  REGION 1..136: note = Description of Unknown:uncultivated organism with predicted taxonomy:Phascolarctobacterium
  REGION 1..136: note = MG18-138 RuvC-III domain

SEQ ID NO: 3309 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-139 RuvC-III domain

SEQ ID NO: 3310 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-140 RuvC-III domain

SEQ ID NO: 3311 - protein, 136 aa, unidentified; identical to SEQ ID NO: 3197
  REGION 1..136: note = Description of Unknown:uncultivated organism with predicted taxonomy: Firmicutes
  REGION 1..136: note = MG18-141 RuvC-III domain

SEQ ID NO: 3312 - protein, 136 aa, unidentified; identical to SEQ ID NO: 3197
  REGION 1..136: note = Description of Unknown:uncultivated organism with predicted taxonomy: Clostridium sp.CAG:964
  REGION 1..136: note = MG18-142 RuvC-III domain

SEQ ID NO: 3313 - protein, 134 aa, unidentified; identical to SEQ ID NO: 3175
  REGION 1..134: note = Description of Unknown:uncultivated organism with predicted taxonomy: Clostridiales
  REGION 1..134: note = MG18-143 RuvC-III domain

SEQ ID NO: 3314 - protein, 134 aa, unidentified; identical to SEQ ID NO: 3175
  REGION 1..134: note = Description of Unknown:uncultivated organism with predicted taxonomy: Firmicutes
  REGION 1..134: note = MG18-144 RuvC-III domain

SEQ ID NO: 3315 - protein, 134 aa, unidentified; identical to SEQ ID NO: 3175
  REGION 1..134: note = Description of Unknown:uncultivated organism with predicted taxonomy: Dorea sp.OM02-2LB
  REGION 1..134: note = MG18-145 RuvC-III domain

SEQ ID NO: 3316 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-146 RuvC-III domain

SEQ ID NO: 3317 - protein, 136 aa, unidentified; identical to SEQ ID NO: 3197
  REGION 1..136: note = Description of Unknown:uncultivated organism with predicted taxonomy: Firmicutes
  REGION 1..136: note = MG18-147 RuvC-III domain

SEQ ID NO: 3318 - protein, 136 aa, unidentified
  REGION 1..136: note = Description of Unknown:uncultivated organism with predicted taxonomy: Lactobacillusoryzae
  REGION 1..136: note = MG18-148 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGKDGTITTVTKTMHKNNILFTRQPVEGK

SEQ ID NO: 3319 - protein, 136 aa, unidentified; identical to SEQ ID NO: 3203
  REGION 1..136: note = Description of Unknown:uncultivated organism with predicted taxonomy:Phascolarctobacterium
  REGION 1..136: note = MG18-149 RuvC-III domain

SEQ ID NO: 3320 - protein, 136 aa, unidentified; identical to SEQ ID NO: 3203
  REGION 1..136: note = Description of Unknown:uncultivated organism with predicted taxonomy: Firmicutes
  REGION 1..136: note = MG18-150 RuvC-III domain

SEQ ID NO: 3321 - protein, 136 aa, unidentified; identical to SEQ ID NO: 3224
  REGION 1..136: note = Description of Unknown:uncultivated organism with predicted taxonomy:Phascolarctobacterium
  REGION 1..136: note = MG18-151 RuvC-III domain

SEQ ID NO: 3322 - protein, 136 aa, unidentified; identical to SEQ ID NO: 3203
  REGION 1..136: note = Description of Unknown:uncultivated organism with predicted taxonomy:Phascolarctobacterium succinatutens
  REGION 1..136: note = MG18-152 RuvC-III domain

SEQ ID NO: 3323 - protein, 136 aa, unidentified; identical to SEQ ID NO: 3197
  REGION 1..136: note = Description of Unknown:uncultivated organism with predicted taxonomy: Firmicutes
  REGION 1..136: note = MG18-153 RuvC-III domain

SEQ ID NO: 3324 - protein, 136 aa, unidentified; identical to SEQ ID NO: 3197
  REGION 1..136: note = Description of Unknown:uncultivated organism with predicted taxonomy:Phascolarctobacterium succinatutens
  REGION 1..136: note = MG18-154 RuvC-III domain

SEQ ID NO: 3325 - protein, 136 aa, unidentified; identical to SEQ ID NO: 3182
  REGION 1..136: note = Description of Unknown:uncultivated organism with predicted taxonomy:Phascolarctobacterium succinatutens
  REGION 1..136: note = MG18-155 RuvC-III domain

SEQ ID NO: 3326 - protein, 136 aa, unidentified; identical to SEQ ID NO: 3197
  REGION 1..136: note = Description of Unknown:uncultivated organism with predicted taxonomy: Clostridium sp.CAG:964
  REGION 1..136: note = MG18-156 RuvC-III domain

SEQ ID NO: 3327 - protein, 136 aa, unidentified; identical to SEQ ID NO: 3224
  REGION 1..136: note = Description of Unknown:uncultivated organism with predicted taxonomy: Ruminococcaceaebacterium
  REGION 1..136: note = MG18-157 RuvC-III domain

SEQ ID NO: 3328 - protein, 136 aa, unidentified; identical to SEQ ID NO: 3182
  REGION 1..136: note = Description of Unknown:uncultivated organism with predicted taxonomy: Clostridium sp.CAG:964
  REGION 1..136: note = MG18-158 RuvC-III domain

SEQ ID NO: 3329 - protein, 136 aa, unidentified; identical to SEQ ID NO: 3205
  REGION 1..136: note = Description of Unknown:uncultivated organism with predicted taxonomy:Phascolarctobacterium succinatutens
  REGION 1..136: note = MG18-159 RuvC-III domain

SEQ ID NO: 3330 - protein, 137 aa, unidentified
  REGION 1..137: note = Description of Unknown:uncultivated organism with predicted taxonomy: Clostridiales
  REGION 1..137: note = MG18-160 RuvC-III domain
VETRQSTKAVAEILQQVYPLSKIVYVKAGLVADFRRYMGHVKCREVNDYHHAKDAYLNIVAGNIYHTRFTDNPYNFIKEAKDKDQKYSLKLEKLLTRDIRRGDITAWDTTGNKTRGVVEKVLARNDIRFTRYPYTEK

SEQ ID NO: 3331 - protein, 164 aa, unidentified
  REGION 1..164: note = Description of Unknown:uncultivated organism with predicted taxonomy: Firmicutes
  REGION 1..164: note = MG21-1 RuvC-III domain
QDTQYLSKVIFRLIENHLQFAETAPGKKHTQPVNGAITAQVRKRLGIEKIREDGDLHHAVDAAVIACITPGMIQKITKYAQNHERFYATAKGYVDIETGEVLTRSEYEAMDDIRFPEPWPGFRSELEARVSEHPQEAIARLKLPHYENSEEIRPIFVSRMPNHK

SEQ ID NO: 3332 - protein, 184 aa, unidentified
  REGION 1..184: note = Description of Unknown:uncultivated organism with predicted taxonomy: Roseburia sp.AM23-20
  REGION 1..184: note = MG21-3 RuvC-III domain
TDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRK

SEQ ID NO: 3333 - protein, 184 aa, unidentified; identical to SEQ ID NO: 3332
  REGION 1..184: note = Description of Unknown:uncultivated organism with predicted taxonomy: Clostridiales
  REGION 1..184: note = MG21-4 RuvC-III domain

SEQ ID NO: 3334 - protein, 184 aa, unidentified; identical to SEQ ID NO: 3332
  REGION 1..184: note = Description of Unknown:uncultivated organism
  REGION 1..184: note = MG21-5 RuvC-III domain

SEQ ID NO: 3335 - protein, 184 aa, unidentified; identical to SEQ ID NO: 3332
  REGION 1..184: note = Description of Unknown:uncultivated organism
  REGION 1..184: note = MG21-6 RuvC-III domain

SEQ ID NO: 3336 - protein, 168 aa, unidentified
  REGION 1..168: note = Description of Unknown:uncultivated organism with predicted taxonomy: Clostridium sp.CAG:571
  REGION 1..168: note = MG21-7 RuvC-III domain
NDTKYICKYMYNLIRNHLEFSDNANFVRKVWTVNGKLTAHIRKRLGIEKVRDGDTHHAVDATVIAITTQNMINRLTRYYQYVDGRYMNNKGEYIDTYTGEIINAKEYEEKYGIYFPEPWPKFRKELDIRTNCKTRERMIECLEAEKIYTYEDYDDVEPIFVSRMPRRK

SEQ ID NO: 3337 - protein, 167 aa, unidentified
  REGION 1..167: note = Description of Unknown:uncultivated organism with predicted taxonomy: Clostridiales
  REGION 1..167: note = MG21-8 RuvC-III domain
NDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHT

SEQ ID NO: 3338 - protein, 163 aa, unidentified
  REGION 1..163: note = Description of Unknown:uncultivated organism
  REGION 1..163: note = MG21-9 RuvC-III domain
TDTQYITKAVADILRNYLAFEEDSPFIKKPVRSINGAVTDQVRKRLGLQKHREEGDLHHAMDAAVIAVTTDGYINRISRYTQRREFGKRIGCYVDLETGEKLTKQAFEQKYEPTFPAPWNKFTKELKARMAPNADEAIRQLYLPSYGSEEIKPIFVSQMPDRK

SEQ ID NO: 3339 - protein, 168 aa, unidentified
  REGION 1..168: note = Description of Unknown:uncultivated organism with predicted taxonomy: Clostridiales
  REGION 1..168: note = MG21-10 RuvC-III domain
NDTKYICKYMYNLIRNHLEFSDNPNFVRKVWTVNGKLTAHIRKRLGIEKVRDGDTHHAVDATVIAITTQNMINRLTRYYQYVDGRYMNNKGEYIDIYTGEIINAKEYEEKNGIYFPEPWPKFRKELDIRTNCKTRERMIECLEAEKIYTYEDYDDVEPIFVSRMPRRK

SEQ ID NO: 3340 - protein, 168 aa, unidentified
  REGION 1..168: note = Description of Unknown:uncultivated organism with predicted taxonomy: Clostridiales
  REGION 1..168: note = MG21-11 RuvC-III domain
NDTKYICKYMYNLIRNHLEFSDNTNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECIEAERIYTYEDYNDVEPIFVSRMPRRK

SEQ ID NO: 3341 - protein, 184 aa, unidentified
  REGION 1..184: note = Description of Unknown:uncultivated organism with predicted taxonomy: Helicobactersp. MIT 11-5569
  REGION 1..184: note = MG21-12 RuvC-III domain
TDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPDRK

SEQ ID NO: 3342 - protein, 168 aa, unidentified
  REGION 1..168: note = Description of Unknown:uncultivated organism with predicted taxonomy: Clostridium
  REGION 1..168: note = MG21-13 RuvC-III domain
QDTQYMCKLMYNLVRNHLEFSDNKNFERKVWTVNGSVTAHIRKRLGIEKTRDGDTHHAVDAAVIAITTQNMINRITKYYQYNDGKYMNNKGEYIDLETGEILDAKEYEAKNGIYFPEPWPKFRKELDIRVNCNSKERMIECLNAEKIFTYEDYEDVEPIFVSRMPRRK

SEQ ID NO: 3343 - protein, 191 aa, unidentified
  REGION 1..191: note = Description of Unknown:uncultivated organism with predicted taxonomy: Clostridiales
  REGION 1..191: note = MG21-14 RuvC-III domain
EDTQYISRLVYKLINNYMEFSDNPNVNRKVRNINGAVTHYIRNRLGIEKIRADGDEHHAVDACIIATTSNYMVNKITRYSQYIDGRFMNDRGEYIDIETGEIINKEEYEEEYGPKFPEPWEGFRRELEIRSSDDVANRAEKTPEELKNIMIQEINDEIKNGKLYSYIEHDDGINRFDDIEPIFVSRMPRRK

SEQ ID NO: 3344 - protein, 168 aa, unidentified
  REGION 1..168: note = Description of Unknown:uncultivated organism
  REGION 1..168: note = MG21-15 RuvC-III domain
QDTQYICKLMYNLVKNHLEFSNNKNFDRKVWTVNGAITSHIRKRLGIEKTRDGDIHHAIDAVVIAITTQEMINKLTKYYQYKDGKYMNNKGEFIDLETGEILDAEKYEKENGIYFPEPWPKFRKELEIRTICPTKETMISYLHNEKIFTYDDYEDVEPIFVSRMPKRK

SEQ ID NO: 3345 - protein, 184 aa, unidentified
  REGION 1..184: note = Description of Unknown:uncultivated organism
  REGION 1..184: note = MG21-16 RuvC-III domain
TDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPNRK

SEQ ID NO: 3346 - protein, 163 aa, unidentified
  REGION 1..163: note = Description of Unknown:uncultivated organism with predicted taxonomy: Clostridiales
  REGION 1..163: note = MG21-17 RuvC-III domain
KDTQYITRSIYNLLRDNLAFAESRYSKKPVQTVNGAVTSMLRSRWGVQKIREDGDLHHCMDAAVIAATSPGLVQRLTEYSKRREALEEAPRGYVDPSTGELVEQSEQPRRDPFPKPWEQFHQELEARLATVDPRHQIDLLKLATYESDEEVKPVFVSRMPNHK

SEQ ID NO: 3347 - protein, 163 aa, unidentified
  REGION 1..163: note = Description of Unknown:uncultivated organism with predicted taxonomy: Clostridialesbacterium 42_27
  REGION 1..163: note = MG21-18 RuvC-III domain
KDTQYITRSIYNLLRDNLAFAESRYSKKPVQTVNGAVTSMLRSRWGVQKIREDGDLHHCMDAAVIAATSPGLVQRLTEYSKQREAFVKAPAGYVDPSTGGLVEQSEASRRDPFPKPWEQFHQELEARLDPIDPQHQIDLLKLATYESDEEVKPVFVSRMPNHK

SEQ ID NO: 3348 - protein, 180 aa, unidentified
  REGION 1..180: note = Description of Unknown:uncultivated organism
  REGION 1..180: note = MG21-19 RuvC-III domain
VGVQNIQKRIADILRNYLRFYGEMPMEQHIVVTKNSITEAICEQLGLQRYYTKVSALSSALNAILIAVTPANYEAKVTQYVQSREEHYTDDGYIDPENGKKLTIEEFDAKYMPESDLKCIYSYLKEEIEIWMSSASDKKSINAKRGKLEKLHKKLGLKGKYENEINNWKPIFVSQMPDRK

SEQ ID NO: 3349 - protein, 163 aa, unidentified; identical to SEQ ID NO: 3346
  REGION 1..163: note = Description of Unknown:uncultivated organism with predicted taxonomy: Clostridiales
  REGION 1..163: note = MG21-20 RuvC-III domain

SEQ ID NO: 3350 - protein, 168 aa, unidentified
  REGION 1..168: note = Description of Unknown:uncultivated organism with predicted taxonomy: Clostridialesbacterium 42_27
  REGION 1..168: note = MG21-21 RuvC-III domain
NDTKYICKYMYNLIRNHLEFSDNPNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLEAEKVYTYEDYDDVEPIFVSRMPRRK

SEQ ID NO: 3351 - protein, 92 aa, unidentified
  REGION 1..92: note = Description of Unknown:uncultivated organism with predicted taxonomy: Clostridiales
  REGION 1..92: note = MG21-22 RuvC-III domain
KDTQYITRAVYNLIRDHLAFAESNYRKKPVQAVNGAVTAMLRGRWGVQKIREDGDLHHCLDAAVIAATTPGLVQCLTAYNKHRETWERPPAG

SEQ ID NO: 3352 - protein, 167 aa, unidentified
  REGION 1..167: note = Description of Unknown:uncultivated organism with predicted taxonomy: Roseburiainulinivorans
  REGION 1..167: note = MG21-23 RuvC-III domain
NDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHT

SEQ ID NO: 3353 - protein, 157 aa, unidentified
  REGION 1..157: note = Description of Unknown:uncultivated organism with predicted taxonomy: Firmicutes
  REGION 1..157: note = MG21-24 RuvC-III domain
NDTQHITRVVYNYLRNNLEFADSAYAKAPVQAVNGAVTAMLRGRWGIEKMRGDGDLHHCKDAVVIAATSRSMIEDLTKYYQEEEQRFMGKTHFVDPATGEVLTRKEFPQPWPRFREELEARLDPIDPMEAVMALHLSTYEPEEEIAPVFVSHMPKHT

SEQ ID NO: 3354 - protein, 163 aa, unidentified
  REGION 1..163: note = Description of Unknown:uncultivated organism with predicted taxonomy: Clostridialesbacterium 42_27
  REGION 1..163: note = MG21-25 RuvC-III domain
KDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARHDPFPKPWERFRQELEARLDPIDPRHQIDLLKLETYESDEEIKPVFVSRMPNHK

SEQ ID NO: 3355 - protein, 163 aa, unidentified
  REGION 1..163: note = Description of Unknown:uncultivated organism with predicted taxonomy: Ruminococcaceaebacterium TF06-43
  REGION 1..163: note = MG21-26 RuvC-III domain
KDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3356 - protein, 166 aa, unidentified
  REGION 1..166: note = Description of Unknown:uncultivated organism with predicted taxonomy: Clostridiales
  REGION 1..166: note = MG21-27 RuvC-III domain
VDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKQTHK

SEQ ID NO: 3357 - protein, 163 aa, unidentified
  REGION 1..163: note = Description of Unknown:uncultivated organism with predicted taxonomy: Clostridialesbacterium 42_27
  REGION 1..163: note = MG21-28 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHK

SEQ ID NO: 3358 - protein, 163 aa, unidentified
  REGION 1..163: note = Description of Unknown:uncultivated organism with predicted taxonomy: Firmicutes
  REGION 1..163: note = MG21-29 RuvC-III domain
KDTQYITRAIYTLIRDNLVFAESNYKKRPVQTVNGAVTSMLRNRWGVQKIREDGDLHHCLDAAVIAATTPGLVQRLTEHSKRRETLEKAPAGYVDPATGELIELPQEARRDPFPKPWERFRQELEARLDPIDPRHQIDLLKLETYESDEEIKPVFVSRMPNHK

SEQ ID NO: 3359 - protein, 163 aa, unidentified
  REGION 1..163: note = Description of Unknown:uncultivated organism with predicted taxonomy: Clostridialesbacterium 42_27
  REGION 1..163: note = MG21-30 RuvC-III domain
KDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3360 - protein, 159 aa, unidentified
  REGION 1..159: note = Description of Unknown:uncultivated organism
  REGION 1..159: note = MG21-31 RuvC-III domain
NDTQHITRVVYNYLRNNLEFADSAYAKAPVQAVNGAVTAMLRGRWGIEKMRGNGDLHHCKDAVVIAATSDSMIKDLTKYYQEEEQRFMGKTHFVDPATGEVLTRKEFPQPWPRFREELEARLDPTNPKEALMALNLSTYEFDPEEEIPPVFVSHMPKHT

SEQ ID NO: 3361 - protein, 163 aa, unidentified
  REGION 1..163: note = Description of Unknown:uncultivated organism with predicted taxonomy: Ruminococcaceaebacterium TF06-43
  REGION 1..163: note = MG21-32 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPASYVDPATGDLLELPQEARRDLFPKPWERFRQELEARLNPIDPRHQIDLLKLSTYESDEEIKPVFVSRMPNHK

SEQ ID NO: 3362 - protein, 166 aa, unidentified
  REGION 1..166: note = Description of Unknown:uncultivated organism with predicted taxonomy: Clostridiales
  REGION 1..166: note = MG21-33 RuvC-III domain
VDTQYIARVIYNLINDHLQFAETGKYDKKRRTQAVNGAITAHVRKRLGIQKIREDGDLHHAVDAAVVACVSPSMIQKITQYTKHRECIRKTKEGYLDTETGELMTREAYDAKYSPRFPAPWERFRQELEARLSDNPAEEIARLHLATYDSEEEIKPVFVSRKQTHK

SEQ ID NO: 3363 - protein, 163 aa, unidentified
  REGION 1..163: note = Description of Unknown:uncultivated organism with predicted taxonomy: Clostridiales
  REGION 1..163: note = MG21-34 RuvC-III domain
KDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHK

SEQ ID NO: 3364 - protein, 163 aa, unidentified
  REGION 1..163: note = Description of Unknown:uncultivated organism with predicted taxonomy: Clostridiales
  REGION 1..163: note = MG21-35 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3365 - protein, 168 aa, unidentified
  REGION 1..168: note = Description of Unknown:uncultivated organism
  REGION 1..168: note = MG21-36 RuvC-III domain
QDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRK

SEQ ID NO: 3366 - protein, 163 aa, unidentified
  REGION 1..163: note = Description of Unknown:uncultivated organism with predicted taxonomy: Clostridiales
  REGION 1..163: note = MG21-37 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHK

SEQ ID NO: 3367 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-38 RuvC-III domain

SEQ ID NO: 3368 - protein, 163 aa, unidentified
  REGION 1..163: note = Description of Unknown:uncultivated organism with predicted taxonomy: Clostridiales
  REGION 1..163: note = MG21-39 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLNPIDPRHQIDLLKLSTYESDEEIKPVFVSRMPNHK

SEQ ID NO: 3369 - protein, 163 aa, unidentified
  REGION 1..163: note = Description of Unknown:uncultivated organism with predicted taxonomy: Clostridiales
  REGION 1..163: note = MG21-40 RuvC-III domain
KDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPQHQIDLLKLATYESDEEIRPVFVSRMPNHK

SEQ ID NO: 3370 - protein, 165 aa, unidentified
  REGION 1..165: note = Description of Unknown:uncultivated organism with predicted taxonomy: Firmicutes
  REGION 1..165: note = MG21-41 RuvC-III domain
NDTQHITRVVYNYLRNNLEFADSAYAKAPVQAVNGAVTAMLRGRWGIEKMRGDGDLHHCKDAVVIAATSRSMVQRLTNYYKEEERLFMGKTHFVDPATGEVLTRKEFQQRFAPKFPQPWDRFREELEARLDPIDPMEAVMALHLSTYEPEEEIAPVFVSHMPKHT

SEQ ID NO: 3371 - protein, 168 aa, unidentified
  REGION 1..168: note = Description of Unknown:uncultivated organism with predicted taxonomy: Clostridiales
  REGION 1..168: note = MG21-42 RuvC-III domain
NDTKYICKYMYNLIRNHLEFSDNANFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLESEKIYTYEDYDDVEPIFVSRMPRRK

SEQ ID NO: 3372 - protein, 163 aa, unidentified
  REGION 1..163: note = Description of Unknown:uncultivated organism with predicted taxonomy: Clostridialesbacterium 42_27
  REGION 1..163: note = MG21-43 RuvC-III domain
KDTQYITRAVYNLIRDHLAFAESNYRKKPVQAVNGAVTAMLRGRWGVQKIREDGDLHPCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHK

SEQ ID NO: 3373 - protein, 168 aa, unidentified
  REGION 1..168: note = Description of Unknown:uncultivated organism with predicted taxonomy: Clostridiales
  REGION 1..168: note = MG21-44 RuvC-III domain
QDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRK

SEQ ID NO: 3374 - protein, 163 aa, unidentified; identical to SEQ ID NO: 3359
  REGION 1..163: note = Description of Unknown:uncultivated organism with predicted taxonomy: Clostridiales
  REGION 1..163: note = MG21-45 RuvC-III domain

SEQ ID NO: 3375 - protein, 168 aa, unidentified; identical to SEQ ID NO: 3371
  REGION 1..168: note = Description of Unknown:uncultivated organism with predicted taxonomy: Clostridiales
  REGION 1..168: note = MG21-46 RuvC-III domain

SEQ ID NO: 3376 - protein, 166 aa, unidentified; identical to SEQ ID NO: 3356
  REGION 1..166: note = Description of Unknown:uncultivated organism with predicted taxonomy: Clostridiales
  REGION 1..166: note = MG21-47 RuvC-III domain

SEQ ID NO: 3377 - protein, 163 aa, unidentified; identical to SEQ ID NO: 3366
  REGION 1..163: note = Description of Unknown:uncultivated organism with predicted taxonomy: Clostridialesbacterium 42_27
  REGION 1..163: note = MG21-48 RuvC-III domain

SEQ ID NO: 3378 - protein, 163 aa, unidentified
  REGION 1..163: note = Description of Unknown:uncultivated organism with predicted taxonomy: Clostridialesbacterium 42_27
  REGION 1..163: note = MG21-49 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHK

SEQ ID NO: 3379 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-50 RuvC-III domain

SEQ ID NO: 3380 - protein, 163 aa, unidentified
  REGION 1..163: note = Description of Unknown:uncultivated organism with predicted taxonomy: Clostridialesbacterium 42_27
  REGION 1..163: note = MG21-51 RuvC-III domain
KDTQYITRAVYNLIREHLVFAESAYRKKPVQTVNGAVTSMLRGRWGVQKIREDGDLHHCLDAAVIAATTPGLVQRLTAYNKRRESWERSPAGYVDPATGELIVLPQEARRDPFPKPWERFRQELEARLDPIDPRHQIDLLKLETYESDEEIKPVFVSRMPNHK

SEQ ID NO: 3381 - protein, 163 aa, unidentified
  REGION 1..163: note = Description of Unknown:uncultivated organism with predicted taxonomy: Clostridialesbacterium 42_27
  REGION 1..163: note = MG21-52 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIQPVFVSRMPNHK

SEQ ID NO: 3382 - protein, 166 aa, unidentified
  REGION 1..166: note = Description of Unknown:uncultivated organism with predicted taxonomy: Clostridiales
  REGION 1..166: note = MG21-53 RuvC-III domain
VDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKPERK

SEQ ID NO: 3383 - protein, 163 aa, unidentified
  REGION 1..163: note = Description of Unknown:uncultivated organism with predicted taxonomy: Clostridiales
  REGION 1..163: note = MG21-54 RuvC-III domain
KDTQYITRTVYNLIRDHLAFAESAYRKKPVQAVNGAVTAMLRGRWGVQKIREDGDLHHCLDAAVIAATTPGLVQRLTAYNKHRETWERPPAGYVDPVTGELIELPQEARRDPFPKPWERFRQELEARLDPIDPRHQIDLLKLETYESDEEIKPVFVSRMPNHK

SEQ ID NO: 3384 - protein, 165 aa, unidentified
  REGION 1..165: note = Description of Unknown:uncultivated organism with predicted taxonomy: Ruminococcaceaebacterium TF06-43
  REGION 1..165: note = MG21-55 RuvC-III domain
NDTQHITRVVYNFLRNNLEFADSAYAKAPVQAVNGAVTAMLRGRWGIEKMRGNGDLHHCKDAVVIAATSDSMIEDLTDYYKEEERLFMGKTHFVDPATGEALTRKEFQQRFAPQFPQPWPRFREELEARLDPIDPMEAVMALHLSTYEPDEEIAPVFVSHMPKHT

SEQ ID NO: 3385 - protein, 163 aa, unidentified
  REGION 1..163: note = Description of Unknown:uncultivated organism with predicted taxonomy: Clostridialesbacterium 42_27
  REGION 1..163: note = MG21-56 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDPLTAETYESDEEIKPVFVSRMPNHK

SEQ ID NO: 3386 - protein, 164 aa, unidentified
  REGION 1..164: note = Description of Unknown:uncultivated organism
  REGION 1..164: note = MG21-57 RuvC-III domain
QDTQYLSKVVFRLIEDHLQFAETAPGKKHTQPVNGAITAQVRKRLGIEKIREDGDLHHAMDAAVIACITPGMIQRITKYAQNHERFYATAKGYADIKTGEVLTRAQYEAMDDIRFPEPWAGFRLELEARVSDHPQEAIAQLKLPHYENSEEIRPIFVSRMPNHK

SEQ ID NO: 3387 - protein, 163 aa, unidentified
  REGION 1..163: note = Description of Unknown:uncultivated organism with predicted taxonomy: Oscillibactersp. CAG:241_62_21
  REGION 1..163: note = MG21-58 RuvC-III domain
KDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHK

SEQ ID NO: 3388 - protein, 163 aa, unidentified; identical to SEQ ID NO: 3387
  REGION 1..163: note = Description of Unknown:uncultivated organism with predicted taxonomy: Clostridiales
  REGION 1..163: note = MG21-59 RuvC-III domain

SEQ ID NO: 3389 - protein, 163 aa, unidentified; identical to SEQ ID NO: 3357
  REGION 1..163: note = Description of Unknown:uncultivated organism with predicted taxonomy: Firmicutes
  REGION 1..163: note = MG21-60 RuvC-III domain

SEQ ID NO: 3390 - protein, 163 aa, unidentified; identical to SEQ ID NO: 3363
  REGION 1..163: note = Description of Unknown:uncultivated organism with predicted taxonomy: Clostridiales
  REGION 1..163: note = MG21-61 RuvC-III domain

SEQ ID NO: 3391 - protein, 163 aa, unidentified; identical to SEQ ID NO: 3366
  REGION 1..163: note = Description of Unknown:uncultivated organism with predicted taxonomy: Firmicutesbacterium CAG:129
  REGION 1..163: note = MG21-62 RuvC-III domain

SEQ ID NO: 3392 - protein, 163 aa, unidentified
  REGION 1..163: note = Description of Unknown:uncultivated organism with predicted taxonomy: Clostridiales
  REGION 1..163: note = MG21-63 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLELETYESDEEIKPVFASRMPNHK

SEQ ID NO: 3393 - protein, 163 aa, unidentified
  REGION 1..163: note = Description of Unknown:uncultivated organism with predicted taxonomy: Clostridiales
  REGION 1..163: note = MG21-64 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHK

SEQ ID NO: 3394 - protein, 160 aa, unidentified
  REGION 1..160: note = Description of Unknown:uncultivated organism with predicted taxonomy: Clostridialesbacterium 42_27
  REGION 1..160: note = MG21-65 RuvC-III domain
VDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVS

SEQ ID NO: 3395 - protein, 163 aa, unidentified; identical to SEQ ID NO: 3393
  REGION 1..163: note = Description of Unknown:uncultivated organism with predicted taxonomy: Clostridiales
  REGION 1..163: note = MG21-66 RuvC-III domain

SEQ ID NO: 3396 - protein, 163 aa, unidentified; identical to SEQ ID NO: 3358
  REGION 1..163: note = Description of Unknown:uncultivated organism with predicted taxonomy: Clostridia
  REGION 1..163: note = MG21-67 RuvC-III domain

SEQ ID NO: 3397 - protein, 163 aa, unidentified; identical to SEQ ID NO: 3378
  REGION 1..163: note = Description of Unknown:uncultivated organism with predicted taxonomy: Clostridiales
  REGION 1..163: note = MG21-68 RuvC-III domain

SEQ ID NO: 3398 - protein, 165 aa, unidentified
  REGION 1..165: note = Description of Unknown:uncultivated organism with predicted taxonomy: Firmicutes
  REGION 1..165: note = MG21-69 RuvC-III domain
NDTQHITRVVYNYLRNNLEFADSAYAKAPVRAVNGAVTAMLRGRWGIEKMRGNGDLHHCKDAVVIAATSRSMVQRLTNYYKEEERLFMGKTNFVDPATGEVLTRKEFQQRFAPKFPQPWDRFREELEARLDPIDPMEAVTALYLSTYEPEEEIAPVFVSHMPKHT

SEQ ID NO: 3399 - protein, 167 aa, unidentified
  REGION 1..167: note = Description of Unknown:uncultivated organism with predicted taxonomy: Firmicutes
  REGION 1..167: note = MG21-70 RuvC-III domain
NDTQHITRVVYNYLRNNLEFADSAYAKAPVRAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHT

SEQ ID NO: 3400 - protein, 157 aa, unidentified; identical to SEQ ID NO: 3353
  REGION 1..157: note = Description of Unknown:uncultivated organism with predicted taxonomy: Clostridiales
  REGION 1..157: note = MG21-71 RuvC-III domain

SEQ ID NO: 3401 - protein, 167 aa, unidentified; identical to SEQ ID NO: 3352
  REGION 1..167: note = Description of Unknown:uncultivated organism
  REGION 1..167: note = MG21-72 RuvC-III domain

SEQ ID NO: 3402 - protein, 163 aa, unidentified; identical to SEQ ID NO: 3393
  REGION 1..163: note = Description of Unknown:uncultivated organism with predicted taxonomy: Clostridiales
  REGION 1..163: note = MG21-73 RuvC-III domain

SEQ ID NO: 3403 - protein, 165 aa, unidentified
  REGION 1..165: note = Description of Unknown:uncultivated organism with predicted taxonomy: Firmicutes
  REGION 1..165: note = MG21-74 RuvC-III domain
NDTQHITRVVYNYLRNNLSFADSTYANAPVQAVSGTVTATLRGRWGIEKMREDGDLHHCKDAVVIAATSPSMIQRLSNYYKEEERLFMGKTHFVDPETGEVLTRKAFQQRFAPKFPQPWDRFREELEARLDPVNPMDAVMALHLSTYEPDEDITPVFVSHMPKHT

SEQ ID NO: 3404 - protein, 168 aa, unidentified
  REGION 1..168: note = Description of Unknown:uncultivated organism with predicted taxonomy: Clostridiales
  REGION 1..168: note = MG21-75 RuvC-III domain
CDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRK

SEQ ID NO: 3405 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-76 RuvC-III domain

SEQ ID NO: 3406 - protein, 166 aa, unidentified
  REGION 1..166: note = Description of Unknown:uncultivated organism with predicted taxonomy: Clostridiales
  REGION 1..166: note = MG21-77 RuvC-III domain
VDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHK

SEQ ID NO: 3407 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-78 RuvC-III domain

SEQ ID NO: 3408 - protein, 163 aa, unidentified
  REGION 1..163: note = Description of Unknown:uncultivated organism with predicted taxonomy: Clostridiales
  REGION 1..163: note = MG21-79 RuvC-III domain
KDTQYITRTVYNLIRNHLAFAESAYRKKPVQAVNGAVTAMLRGRWGVQKIREDSDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3409 - protein, 164 aa, unidentified
  REGION 1..164: note = Description of Unknown:uncultivated organism with predicted taxonomy: Clostridiales
  REGION 1..164: note = MG21-80 RuvC-III domain
QDTQYLSKVVFRLIEDHLQFAKTAPGKKHTQPVNGAITAQVRKRLGIEKIREDGDLHHAMDAAVIACITPGMIQRITKYAQNHERFYATAKGYVDIKTGEVLTRAQYEAMDDIRFPEPWAGFRLELEARVSDHPQEAIAQLKLPHYENSEEIRPIFVSRMPNHK

SEQ ID NO: 3410 - protein, 163 aa, unidentified
  REGION 1..163: note = Description of Unknown:uncultivated organism with predicted taxonomy: Clostridiales
  REGION 1..163: note = MG21-81 RuvC-III domain
KDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHK

SEQ ID NO: 3411 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-82 RuvC-III domain

SEQ ID NO: 3412 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-83 RuvC-III domain

SEQ ID NO: 3413 - protein, 163 aa, unidentified
  REGION 1..163: note = Description of Unknown:uncultivated organism with predicted taxonomy: Clostridiales
  REGION 1..163: note = MG21-84 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHK

SEQ ID NO: 3414 - protein, 166 aa, unidentified
  REGION 1..166: note = Description of Unknown:uncultivated organism with predicted taxonomy: Clostridiales
  REGION 1..166: note = MG21-85 RuvC-III domain
VDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYPPRFPAPWERFRQELEARLSDNPAEEIARLHLATYDSEEEIKPVFVSRKPERK

SEQ ID NO: 3415 - protein, 163 aa, unidentified; identical to SEQ ID NO: 3410
  REGION 1..163: note = Description of Unknown:uncultivated organism with predicted taxonomy: Firmicutes
  REGION 1..163: note = MG21-86 RuvC-III domain

SEQ ID NO: 3416 - protein, 163 aa, unidentified; identical to SEQ ID NO: 3363
  REGION 1..163: note = Description of Unknown:uncultivated organism with predicted taxonomy: Clostridiales
  REGION 1..163: note = MG21-87 RuvC-III domain

SEQ ID NO: 3417 - protein, 166 aa, unidentified
  REGION 1..166: note = Description of Unknown:uncultivated organism with predicted taxonomy: Clostridiales
  REGION 1..166: note = MG21-88 RuvC-III domain
VDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKPVFVSRKQTHK

SEQ ID NO: 3418 - protein, 163 aa, unidentified; identical to SEQ ID NO: 3363
  REGION 1..163: note = Description of Unknown:uncultivated organism with predicted taxonomy: Clostridiales
  REGION 1..163: note = MG21-89 RuvC-III domain

SEQ ID NO: 3419 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-90 RuvC-III domain

SEQ ID NO: 3420 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-91 RuvC-III domain

SEQ ID NO: 3421 - protein, 163 aa, unidentified
  REGION 1..163: note = Description of Unknown:uncultivated organism with predicted taxonomy: Ruminococcaceaebacterium TF06-43
  REGION 1..163: note = MG21-92 RuvC-III domain
KDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLNPIDPRHQIDLLKLETYESDEEIKPVFASRMPNHK

SEQ ID NO: 3422 - protein, 163 aa, unidentified; identical to SEQ ID NO: 3363
  REGION 1..163: note = Description of Unknown:uncultivated organism with predicted taxonomy: Ruminococcaceaebacterium TF06-43
  REGION 1..163: note = MG21-93 RuvC-III domain

SEQ ID NO: 3423 - protein, 163 aa, unidentified; identical to SEQ ID NO: 3413
  REGION 1..163: note = Description of Unknown:uncultivated organism with predicted taxonomy: Clostridiales
  REGION 1..163: note = MG21-94 RuvC-III domain

SEQ ID NO: 3424 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-95 RuvC-III domain

SEQ ID NO: 3425 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-96 RuvC-III domain

SEQ ID NO: 3426 - protein, 168 aa, unidentified
  REGION 1..168: note = Description of Unknown:uncultivated organism with predicted taxonomy: Clostridium
  REGION 1..168: note = MG21-97 RuvC-III domain
QDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAVKIYYENYDDVKPVFISRMPRRK

SEQ ID NO: 3427 - protein, 166 aa, unidentified
  REGION 1..166: note = Description of Unknown:uncultivated organism with predicted taxonomy: Clostridiales
  REGION 1..166: note = MG21-98 RuvC-III domain
VDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYSPRFPAPWERFRQELEARLSDNPAEEIARLHLATYDSEEEIKPVFVSRKPKRK

SEQ ID NO: 3428 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-99 RuvC-III domain

SEQ ID NO: 3429 - protein, 163 aa, unidentified; identical to SEQ ID NO: 3363
  REGION 1..163: note = Description of Unknown:uncultivated organism with predicted taxonomy: Clostridiales
  REGION 1..163: note = MG21-100 RuvC-III domain

SEQ ID NO: 3430 - protein, 168 aa, unidentified
  REGION 1..168: note = Description of Unknown:uncultivated organism with predicted taxonomy: Clostridiales
  REGION 1..168: note = MG21-101 RuvC-III domain
QDTQYISRLMYNLIKNHVQFSNNENFERKVFTVNGQITSHIGKRLGINKIRENGDEHHATDAVIIATVSQGMIQRITKYYQYIDGRYEKNSGEYIDMETGEIITKEQYEAKNGSNFPEPWPKFRKELDIRTTCKTKARMEECLLTEKIFYDDYDDVKPIFISRMPKRK

SEQ ID NO: 3431 - protein, 168 aa, unidentified; identical to SEQ ID NO: 3373
  REGION 1..168: note = Description of Unknown:uncultivated organism with predicted taxonomy: Clostridium
  REGION 1..168: note = MG21-102 RuvC-III domain

SEQ ID NO: 3432 - protein, 163 aa, unidentified
  REGION 1..163: note = Description of Unknown:uncultivated organism with predicted taxonomy: Clostridiales
  REGION 1..163: note = MG21-103 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHK

SEQ ID NO: 3433 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-104 RuvC-III domain

SEQ ID NO: 3434 - protein, 163 aa, unidentified
  REGION 1..163: note = Description of Unknown:uncultivated organism with predicted taxonomy: Clostridialesbacterium 42_27
  REGION 1..163: note = MG21-105 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHK

SEQ ID NO: 3435 - protein, 109 aa, unidentified
  REGION 1..109: note = Description of Unknown:uncultivated organism with predicted taxonomy: Oscillibactersp. CAG:241_62_21
  REGION 1..109: note = MG21-106 RuvC-III domain
KDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQ

SEQ ID NO: 3436 - protein, 168 aa, unidentified; identical to SEQ ID NO: 3373
  REGION 1..168: note = Description of Unknown:uncultivated organism with predicted taxonomy: Clostridium
  REGION 1..168: note = MG21-107 RuvC-III domain

SEQ ID NO: 3437 - protein, 163 aa, unidentified; identical to SEQ ID NO: 3363
  REGION 1..163: note = Description of Unknown:uncultivated organism with predicted taxonomy: Clostridiales
  REGION 1..163: note = MG21-108 RuvC-III domain

SEQ ID NO: 3438 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-109 RuvC-III domain

SEQ ID NO: 3439 - protein, 163 aa, unidentified; identical to SEQ ID NO: 3387
  REGION 1..163: note = Description of Unknown:uncultivated organism with predicted taxonomy: Oscillibactersp. CAG:241_62_21
  REGION 1..163: note = MG21-110 RuvC-III domain

SEQ ID NO: 3440 - protein, 163 aa, unidentified; identical to SEQ ID NO: 3432
  REGION 1..163: note = Description of Unknown:uncultivated organism with predicted taxonomy: Clostridiales
  REGION 1..163: note = MG21-111 RuvC-III domain

SEQ ID NO: 3441 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-112 RuvC-III domain

SEQ ID NO: 3442 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-113 RuvC-III domain

SEQ ID NO: 3443 - protein, 163 aa, unidentified
  REGION 1..163: note = Description of Unknown:uncultivated organism with predicted taxonomy: Clostridialesbacterium 42_27
  REGION 1..163: note = MG21-114 RuvC-III domain
KDTQYITRAVYNLIRDHLTFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3444 - protein, 166 aa, unidentified; identical to SEQ ID NO: 3406
  REGION 1..166: note = Description of Unknown:uncultivated organism with predicted taxonomy: Clostridiales
  REGION 1..166: note = MG21-115 RuvC-III domain

SEQ ID NO: 3445 - protein, 163 aa, unidentified; identical to SEQ ID NO: 3363
  REGION 1..163: note = Description of Unknown:uncultivated organism with predicted taxonomy: Clostridiales
  REGION 1..163: note = MG21-116 RuvC-III domain

SEQ ID NO: 3446 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-117 RuvC-III domain

SEQ ID NO: 3447 - protein, 163 aa, unidentified; identical to SEQ ID NO: 3359
  REGION 1..163: note = Description of Unknown:uncultivated organism with predicted taxonomy: Clostridialesbacterium 42_27
  REGION 1..163: note = MG21-118 RuvC-III domain

SEQ ID NO: 3448 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-119 RuvC-III domain

SEQ ID NO: 3449 - protein, 163 aa, unidentified; identical to SEQ ID NO: 3363
  REGION 1..163: note = Description of Unknown:uncultivated organism with predicted taxonomy: Ruminococcaceaebacterium TF06-43
  REGION 1..163: note = MG21-120 RuvC-III domain

SEQ ID NO: 3450 - protein, 163 aa, unidentified; identical to SEQ ID NO: 3432
  REGION 1..163: note = Description of Unknown:uncultivated organism with predicted taxonomy: Clostridiales
  REGION 1..163: note = MG21-121 RuvC-III domain

SEQ ID NO: 3451 - protein, 165 aa, unidentified; identical to SEQ ID NO: 3398
  REGION 1..165: note = Description of Unknown:uncultivated organism
  REGION 1..165: note = MG21-122 RuvC-III domain

SEQ ID NO: 3452 - protein, 163 aa, unidentified; identical to SEQ ID NO: 3357
  REGION 1..163: note = Description of Unknown:uncultivated organism with predicted taxonomy: Clostridiales
  REGION 1..163: note = MG21-123 RuvC-III domain

SEQ ID NO: 3453 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-124 RuvC-III domain

SEQ ID NO: 3454 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-125 RuvC-III domain

SEQ ID NO: 3455 - protein, 95 aa, unidentified
  REGION 1..95: note = Description of Unknown:uncultivated organism with predicted taxonomy: Clostridialesbacterium 42_27
  REGION 1..95: note = MG21-126 RuvC-III domain
KDTQYITRAVYNLIRDHLAFAESNYRKKPVQAVNGAVAAMLRGRWGVQKIREDGDLHHCLDAAVIAATTPGLVQRLTAYNKHRETWERSPAGYVD

SEQ ID NO: 3456 - protein, 163 aa, unidentified
  REGION 1..163: note = Description of Unknown:uncultivated organism with predicted taxonomy: Clostridialesbacterium 42_27
  REGION 1..163: note = MG21-127 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLNPIDPRHQIDLLKLETYESDEEIKPVFVSRMPNHK

SEQ ID NO: 3457 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-128 RuvC-III domain

SEQ ID NO: 3458 - protein, 163 aa, unidentified; identical to SEQ ID NO: 3434
  REGION 1..163: note = Description of Unknown:uncultivated organism with predicted taxonomy: Clostridialesbacterium 42_27
  REGION 1..163: note = MG21-129 RuvC-III domain

SEQ ID NO: 3459 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-130 RuvC-III domain

SEQ ID NO: 3460 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-131 RuvC-III domain

SEQ ID NO: 3461 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-132 RuvC-III domain

SEQ ID NO: 3462 - protein, 163 aa, unidentified; identical to SEQ ID NO: 3387
  REGION 1..163: note = Description of Unknown:uncultivated organism with predicted taxonomy: Clostridiales
  REGION 1..163: note = MG21-133 RuvC-III domain

SEQ ID NO: 3463 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-134 RuvC-III domain

SEQ ID NO: 3464 - protein, 163 aa, unidentified; identical to SEQ ID NO: 3357
  REGION 1..163: note = Description of Unknown:uncultivated organism with predicted taxonomy: Clostridiales
  REGION 1..163: note = MG21-135 RuvC-III domain

SEQ ID NO: 3465 - protein, 167 aa, unidentified; identical to SEQ ID NO: 3337
  REGION 1..167: note = Description of Unknown:uncultivated organism with predicted taxonomy: Clostridiales
  REGION 1..167: note = MG21-136 RuvC-III domain

SEQ ID NO: 3466 - protein, 168 aa, unidentified
  REGION 1..168: note = Description of Unknown:uncultivated organism with predicted taxonomy: Clostridiales
  REGION 1..168: note = MG21-137 RuvC-III domain
QDTQYISRLMYNLIKDHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRK

SEQ ID NO: 3467 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-138 RuvC-III domain

SEQ ID NO: 3468 - protein, 163 aa, unidentified; identical to SEQ ID NO: 3357
  REGION 1..163: note = Description of Unknown:uncultivated organism with predicted taxonomy: Clostridiales
  REGION 1..163: note = MG21-139 RuvC-III domain

SEQ ID NO: 3469 - protein, 163 aa, unidentified; identical to SEQ ID NO: 3378
  REGION 1..163: note = Description of Unknown:uncultivated organism with predicted taxonomy: Clostridialesbacterium 42_27
  REGION 1..163: note = MG21-140 RuvC-III domain

SEQ ID NO: 3470 - protein, 165 aa, unidentified
  REGION 1..165: note = Description of Unknown:uncultivated organism with predicted taxonomy: Firmicutes
  REGION 1..165: note = MG21-141 RuvC-III domain
NDTQHITRVVYNYLRNNLEFADSAYAKAPVQAVNGAVTAMLRGRWGIEKMRGDGDLHHCKDAVVIAATSPSMIQRLSNYYKEEERLFMGKTHFVDPGTGEVLTRKEFQQRFAPQFPQPWPRFREELEARLDPVNPTEALMALHLSTYEPEEEIKPVFVSHMPKRT

SEQ ID NO: 3471 - protein, 163 aa, unidentified; identical to SEQ ID NO: 3357
  REGION 1..163: note = Description of Unknown:uncultivated organism with predicted taxonomy: Clostridialesbacterium 42_27
  REGION 1..163: note = MG21-142 RuvC-III domain

SEQ ID NO: 3472 - protein, 163 aa, unidentified; identical to SEQ ID NO: 3434
  REGION 1..163: note = Description of Unknown:uncultivated organism with predicted taxonomy: Clostridialesbacterium 42_27
  REGION 1..163: note = MG21-143 RuvC-III domain

SEQ ID NO: 3473 - protein, 166 aa, unidentified; identical to SEQ ID NO: 3406
  REGION 1..166: note = Description of Unknown:uncultivated organism with predicted taxonomy: Clostridiales
  REGION 1..166: note = MG21-144 RuvC-III domain

SEQ ID NO: 3474 - protein, 163 aa, unidentified
  REGION 1..163: note = Description of Unknown:uncultivated organism with predicted taxonomy: Clostridiales
  REGION 1..163: note = MG21-145 RuvC-III domain
VDTQYLSRVIFRLIDENMAFAETGNYKRKTQTVSGAITAQVRKRLGIDKIRENGDLHHAADAAVIACISPGMVHKVTNYAKRCELYRDGQGYIDYETGEVMTKEAFDEKYAPRFPEPWPMFRKELEARLSADPRAEIEHLNLPAYDSSDELRPVFVSRMPRHK

SEQ ID NO: 3475 - protein, 186 aa, unidentified
  REGION 1..186: note = Description of Unknown:uncultivated organism with predicted taxonomy: Bacteroidales
  REGION 1..186: note = MG22-1 RuvC-III domain
NDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLR

SEQ ID NO: 3476 - protein, 186 aa, unidentified
  REGION 1..186: note = Description of Unknown:uncultivated organism with predicted taxonomy: Bacteroidales
  REGION 1..186: note = MG22-3 RuvC-III domain
SDTRYIARYIKGILSNIVRQRAADGTLEQEATSKNLIVCTGQITDRVKQDWGLNDVWNHIITPRFERLNRMTGSNDYGEWCCKEGKRYFQTRVPLHLQIGFNKKRIDHRHHAMDAIAIACVNRNVVNYLNNAAAHATDRMDLRMRICRPSGNGQTKKEIRSPWKNFAHDAECALQAITVSFKQNVR

SEQ ID NO: 3477 - protein, 186 aa, unidentified; identical to SEQ ID NO: 3476
  REGION 1..186: note = Description of Unknown:uncultivated organism with predicted taxonomy: Bacteroidales
  REGION 1..186: note = MG22-4 RuvC-III domain

SEQ ID NO: 3478 - protein, 186 aa, unidentified
  REGION 1..186: note = Description of Unknown:uncultivated organism with predicted taxonomy: Bacteroidales
  REGION 1..186: note = MG22-5 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3479 - protein, 186 aa, unidentified
  REGION 1..186: note = Description of Unknown:uncultivated organism with predicted taxonomy: Bacteroidales
  REGION 1..186: note = MG22-6 RuvC-III domain
NDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3480 - protein, 186 aa, unidentified; identical to SEQ ID NO: 3478
  REGION 1..186: note = Description of Unknown:uncultivated organism with predicted taxonomy: Prevotella
  REGION 1..186: note = MG22-7 RuvC-III domain

SEQ ID NO: 3481 - protein, 186 aa, unidentified; identical to SEQ ID NO: 3479
  REGION 1..186: note = Description of Unknown:uncultivated organism with predicted taxonomy: Bacteroidales
  REGION 1..186: note = MG22-8 RuvC-III domain

SEQ ID NO: 3482 - protein, 186 aa, unidentified
  REGION 1..186: note = Description of Unknown:uncultivated organism with predicted taxonomy: Bacteroidales
  REGION 1..186: note = MG22-9 RuvC-III domain
NDTRYIARFMKGFLSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLR

SEQ ID NO: 3483 - protein, 186 aa, unidentified
  REGION 1..186: note = Description of Unknown:uncultivated organism with predicted taxonomy: Bacteroidales
  REGION 1..186: note = MG22-10 RuvC-III domain
NDTRYIARFMKGILSNIVREKNADGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3484 - protein, 89 aa, unidentified
  REGION 1..89: note = Description of Unknown:uncultivated organism with predicted taxonomy: Prevotella sp.MGM2
  REGION 1..89: note = MG22-12 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYF

SEQ ID NO: 3485 - protein, 186 aa, unidentified
  REGION 1..186: note = Description of Unknown:uncultivated organism with predicted taxonomy: Prevotella
  REGION 1..186: note = MG22-13 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLSLQKGFNKKRIDHRHHAMDAIAIACVNRSIVNYLNNAAANQTEREDLRRAVCIPERNGQTKRQLRSPWLCFARDTENALRQIVVSFKQNLR

SEQ ID NO: 3486 - protein, 186 aa, unidentified; identical to SEQ ID NO: 3478
  REGION 1..186: note = Description of Unknown:uncultivated organism with predicted taxonomy: Prevotella sp.MGM2
  REGION 1..186: note = MG22-15 RuvC-III domain

SEQ ID NO: 3487 - protein, 186 aa, unidentified
  REGION 1..186: note = Description of Unknown:uncultivated organism with predicted taxonomy: Prevotella sp.MGM2
  REGION 1..186: note = MG22-16 RuvC-III domain
NDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLR

SEQ ID NO: 3488 - protein, 186 aa, unidentified
  REGION 1..186: note = Description of Unknown:uncultivated organism with predicted taxonomy: Prevotella
  REGION 1..186: note = MG22-17 RuvC-III domain
NDTRYIARFMKGILSNIVREKNTDGILEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3489 - protein, 186 aa, unidentified; identical to SEQ ID NO: 3487
  REGION 1..186: note = Description of Unknown:uncultivated organism with predicted taxonomy: Bacteroidales
  REGION 1..186: note = MG22-18 RuvC-III domain

SEQ ID NO: 3490 - protein, 186 aa, unidentified
  REGION 1..186: note = Description of Unknown:uncultivated organism with predicted taxonomy: Prevotella
  REGION 1..186: note = MG22-19 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLR

SEQ ID NO: 3491 - protein, 186 aa, unidentified
  REGION 1..186: note = Description of Unknown:uncultivated organism with predicted taxonomy: Bacteroidales
  REGION 1..186: note = MG22-21 RuvC-III domain
NDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3492 - protein, 186 aa, unidentified
  REGION 1..186: note = Description of Unknown:uncultivated organism with predicted taxonomy: Bacteroidales
  REGION 1..186: note = MG22-22 RuvC-III domain
NDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLR

SEQ ID NO: 3493 - protein, 185 aa, unidentified
  REGION 1..185: note = Description of Unknown:uncultivated organism with predicted taxonomy: Bacteroidales
  REGION 1..185: note = MG22-23 RuvC-III domain
TDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTR

SEQ ID NO: 3494 - protein, 186 aa, unidentified
  REGION 1..186: note = Description of Unknown:uncultivated organism with predicted taxonomy: Bacteroidales
  REGION 1..186: note = MG22-24 RuvC-III domain
NDTRYIARFMKGILSNIVREKNADGTLEPEETSKNLIVCSGRITDRVKQDWGLNDIWNHIITSRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3495 - protein, 186 aa, unidentified
  REGION 1..186: note = Description of Unknown:uncultivated organism with predicted taxonomy: Prevotella sp.MGM2
  REGION 1..186: note = MG22-25 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLR

SEQ ID NO: 3496 - protein, 186 aa, unidentified
  REGION 1..186: note = Description of Unknown:uncultivated organism with predicted taxonomy: Bacteroidales
  REGION 1..186: note = MG22-26 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLR

SEQ ID NO: 3497 - protein, 186 aa, unidentified
  REGION 1..186: note = Description of Unknown:uncultivated organism with predicted taxonomy: Prevotella sp.MGM2
  REGION 1..186: note = MG22-27 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLR

SEQ ID NO: 3498 - protein, 186 aa, unidentified; identical to SEQ ID NO: 3478
  REGION 1..186: note = Description of Unknown:uncultivated organism with predicted taxonomy: Bacteroidales
  REGION 1..186: note = MG22-28 RuvC-III domain

SEQ ID NO: 3499 - protein, 186 aa, unidentified
  REGION 1..186: note = Description of Unknown:uncultivated organism with predicted taxonomy: Bacteroidales
  REGION 1..186: note = MG22-29 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3500 - protein, 186 aa, unidentified
  REGION 1..186: note = Description of Unknown:uncultivated organism with predicted taxonomy: Prevotella sp.MGM2
  REGION 1..186: note = MG22-30 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLR

SEQ ID NO: 3501 - protein, 186 aa, unidentified; identical to SEQ ID NO: 3478
  REGION 1..186: note = Description of Unknown:uncultivated organism with predicted taxonomy: Bacteroidales
  REGION 1..186: note = MG22-31 RuvC-III domain

SEQ ID NO: 3502 - protein, 186 aa, unidentified; identical to SEQ ID NO: 3478
  REGION 1..186: note = Description of Unknown:uncultivated organism with predicted taxonomy: Bacteroidales
  REGION 1..186: note = MG22-33 RuvC-III domain

SEQ ID NO: 3503 - protein, 185 aa, unidentified
  REGION 1..185: note = Description of Unknown:uncultivated organism with predicted taxonomy: Bacteroidales
  REGION 1..185: note = MG22-34 RuvC-III domain
TDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTR

SEQ ID NO: 3504 - protein, 185 aa, unidentified; identical to SEQ ID NO: 3503
  REGION 1..185: note = Description of Unknown:uncultivated organism with predicted taxonomy: Parabacteroidessp. An277
  REGION 1..185: note = MG22-35 RuvC-III domain

SEQ ID NO: 3505 - protein, 185 aa, unidentified; identical to SEQ ID NO: 3493
  REGION 1..185: note = Description of Unknown:uncultivated organism with predicted taxonomy: Bacteroidales
  REGION 1..185: note = MG22-36 RuvC-III domain

SEQ ID NO: 3506 - protein, 186 aa, unidentified
  REGION 1..186: note = Description of Unknown:uncultivated organism with predicted taxonomy: Bacteroidales
  REGION 1..186: note = MG22-37 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENVLRQIVVSFKQNLR

SEQ ID NO: 3507 - protein, 186 aa, unidentified
  REGION 1..186: note = Description of Unknown:uncultivated organism with predicted taxonomy: Prevotella
  REGION 1..186: note = MG22-38 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRMPLSLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3508 - protein, 186 aa, unidentified; identical to SEQ ID NO: 3478
  REGION 1..186: note = Description of Unknown:uncultivated organism with predicted taxonomy: Prevotella sp.MGM2
  REGION 1..186: note = MG22-39 RuvC-III domain

SEQ ID NO: 3509 - protein, 185 aa, unidentified; identical to SEQ ID NO: 3503
  REGION 1..185: note = Description of Unknown:uncultivated organism with predicted taxonomy: Bacteroidales
  REGION 1..185: note = MG22-40 RuvC-III domain

SEQ ID NO: 3510 - protein, 186 aa, unidentified
  REGION 1..186: note = Description of Unknown:uncultivated organism with predicted taxonomy: Bacteroidales
  REGION 1..186: note = MG22-41 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALQQIVVSFKQNLR

SEQ ID NO: 3511 - protein, 186 aa, unidentified; identical to SEQ ID NO: 3494
  REGION 1..186: note = Description of Unknown:uncultivated organism with predicted taxonomy: Prevotella
  REGION 1..186: note = MG22-42 RuvC-III domain

SEQ ID NO: 3512 - protein, 186 aa, unidentified
  REGION 1..186: note = Description of Unknown:uncultivated organism with predicted taxonomy: Bacteroidales
  REGION 1..186: note = MG22-43 RuvC-III domain
NDTRYIARFMKGILSNIVREKNADGTLESEETSKNLIVCSGRITDRVKQDWGLNDIWNHIITPRFERLNTKTSSDKFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLR

SEQ ID NO: 3513 - protein, 186 aa, unidentified
  REGION 1..186: note = Description of Unknown:uncultivated organism with predicted taxonomy: Bacteroidales
  REGION 1..186: note = MG22-44 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLR

SEQ ID NO: 3514 - protein, 186 aa, unidentified; identical to SEQ ID NO: 3513
  REGION 1..186: note = Description of Unknown:uncultivated organism with predicted taxonomy: Bacteroidales
  REGION 1..186: note = MG22-45 RuvC-III domain

SEQ ID NO: 3515 - protein, 185 aa, unidentified; identical to SEQ ID NO: 3503
  REGION 1..185: note = Description of Unknown:uncultivated organism with predicted taxonomy: Bacteroidales
  REGION 1..185: note = MG22-46 RuvC-III domain

SEQ ID NO: 3516 - protein, 186 aa, unidentified; identical to SEQ ID NO: 3478
  REGION 1..186: note = Description of Unknown:uncultivated organism with predicted taxonomy: Bacteroidales
  REGION 1..186: note = MG22-47 RuvC-III domain

SEQ ID NO: 3517 - protein, 185 aa, unidentified; identical to SEQ ID NO: 3503
  REGION 1..185: note = Description of Unknown:uncultivated organism with predicted taxonomy: Bacteroidales
  REGION 1..185: note = MG22-48 RuvC-III domain

SEQ ID NO: 3518 - protein, 186 aa, unidentified
  REGION 1..186: note = Description of Unknown:uncultivated organism with predicted taxonomy: Bacteroidales
  REGION 1..186: note = MG22-49 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFAKDAENALRQIVVSFKQNLR

SEQ ID NO: 3519 - protein, 186 aa, unidentified; identical to SEQ ID NO: 3497
  REGION 1..186: note = Description of Unknown:uncultivated organism with predicted taxonomy: Bacteroidales
  REGION 1..186: note = MG22-50 RuvC-III domain

SEQ ID NO: 3520 - protein, 185 aa, unidentified
  REGION 1..185: note = Description of Unknown:uncultivated organism with predicted taxonomy: Prevotellaceae
  REGION 1..185: note = MG22-51 RuvC-III domain
TDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTR

SEQ ID NO: 3521 - protein, 6 aa, unidentified
  REGION 1..6: note = Description of Unknown:uncultivated organism with predicted taxonomy: Prevotella sp.MGM2
  REGION 1..6: note = MG22-52 RuvC-III domain
ITNRII

SEQ ID NO: 3522 - protein, 186 aa, unidentified
  REGION 1..186: note = Description of Unknown:uncultivated organism with predicted taxonomy: Bacteroidales
  REGION 1..186: note = MG22-53 RuvC-III domain
NDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3523 - protein, 186 aa, unidentified
  REGION 1..186: note = Description of Unknown:uncultivated organism with predicted taxonomy: Bacteroidales
  REGION 1..186: note = MG22-54 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLR

SEQ ID NO: 3524 - protein, 186 aa, unidentified; identical to SEQ ID NO: 3523
  REGION 1..186: note = Description of Unknown:uncultivated organism with predicted taxonomy: Bacteroidales
  REGION 1..186: note = MG22-55 RuvC-III domain

SEQ ID NO: 3525 - protein, 186 aa, unidentified
  REGION 1..186: note = Description of Unknown:uncultivated organism with predicted taxonomy: Bacteroidales
  REGION 1..186: note = MG22-56 RuvC-III domain
NDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWPCFARDTENALRQIVVSFKQNLR

SEQ ID NO: 3526 - protein, 186 aa, unidentified
  REGION 1..186: note = Description of Unknown:uncultivated organism with predicted taxonomy: Bacteroidales
  REGION 1..186: note = MG22-57 RuvC-III domain
NDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVYIPERNGQTKRQLRSPWHCFARDAENALRQIVVSFKQNLR

SEQ ID NO: 3527 - protein, 186 aa, unidentified; identical to SEQ ID NO: 3495
  REGION 1..186: note = Description of Unknown:uncultivated organism with predicted taxonomy: Bacteroidales
  REGION 1..186: note = MG22-58 RuvC-III domain

SEQ ID NO: 3528 - protein, 186 aa, unidentified; identical to SEQ ID NO: 3492
  REGION 1..186: note = Description of Unknown:uncultivated organism with predicted taxonomy: Bacteroidales
  REGION 1..186: note = MG22-59 RuvC-III domain

SEQ ID NO: 3529 - protein, 186 aa, unidentified; identical to SEQ ID NO: 3497
  REGION 1..186: note = Description of Unknown:uncultivated organism with predicted taxonomy: Bacteroidales
  REGION 1..186: note = MG22-60 RuvC-III domain

SEQ ID NO: 3530 - protein, 186 aa, unidentified
  REGION 1..186: note = Description of Unknown:uncultivated organism with predicted taxonomy: Bacteroidales
  REGION 1..186: note = MG22-61 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQIEREDLRRAVCIPERNGQTKRQLRSPWHCFARDAENALRQIVVSFKQNLR

SEQ ID NO: 3531 - protein, 186 aa, unidentified; identical to SEQ ID NO: 3495
  REGION 1..186: note = Description of Unknown:uncultivated organism with predicted taxonomy: Bacteroidales
  REGION 1..186: note = MG22-62 RuvC-III domain

SEQ ID NO: 3532 - protein, 186 aa, unidentified
  REGION 1..186: note = Description of Unknown:uncultivated organism with predicted taxonomy: Prevotella sp.MGM2
  REGION 1..186: note = MG22-64 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3533 - protein, 186 aa, unidentified
  REGION 1..186: note = Description of Unknown:uncultivated organism with predicted taxonomy: Prevotella
  REGION 1..186: note = MG22-65 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLR

SEQ ID NO: 3534 - protein, 40 aa, unidentified
  REGION 1..40: note = Description of Unknown:uncultivated organism with predicted taxonomy: Prevotella sp.MGM2
  REGION 1..40: note = MG22-66 RuvC-III domain
NDTRYIARFMKGILSNIVREKNADGTLEPEETSKNLIVCS

SEQ ID NO: 3535 - protein, 186 aa, unidentified; identical to SEQ ID NO: 3497
  REGION 1..186: note = Description of Unknown:uncultivated organism with predicted taxonomy: Bacteroidales
  REGION 1..186: note = MG22-68 RuvC-III domain

SEQ ID NO: 3536 - protein, 186 aa, unidentified
  REGION 1..186: note = Description of Unknown:uncultivated organism with predicted taxonomy: Bacteroidales
  REGION 1..186: note = MG22-69 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAITIACVNRSIVNYLNNAAANQTEREDLRRAVCIPERNGQTKRQLRSPWHCFARDAENALRQIVVSFKQNLR

SEQ ID NO: 3537 - protein, 186 aa, unidentified
  REGION 1..186: note = Description of Unknown:uncultivated organism with predicted taxonomy: Bacteroidales
  REGION 1..186: note = MG22-70 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLR

SEQ ID NO: 3538 - protein, 185 aa, unidentified; identical to SEQ ID NO: 3520
  REGION 1..185: note = Description of Unknown:uncultivated organism with predicted taxonomy: Bacteroidales
  REGION 1..185: note = MG22-71 RuvC-III domain

SEQ ID NO: 3539 - protein, 186 aa, unidentified
  REGION 1..186: note = Description of Unknown:uncultivated organism with predicted taxonomy: Bacteroidales
  REGION 1..186: note = MG22-72 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3540 - protein, 186 aa, unidentified; identical to SEQ ID NO: 3487
  REGION 1..186: note = Description of Unknown:uncultivated organism with predicted taxonomy: Prevotella sp.MGM2
  REGION 1..186: note = MG22-73 RuvC-III domain

SEQ ID NO: 3541 - protein, 186 aa, unidentified; identical to SEQ ID NO: 3487
  REGION 1..186: note = Description of Unknown:uncultivated organism with predicted taxonomy: Bacteroidales
  REGION 1..186: note = MG22-74 RuvC-III domain

SEQ ID NO: 3542 - protein, 186 aa, unidentified
  REGION 1..186: note = Description of Unknown:uncultivated organism with predicted taxonomy: Bacteroidales
  REGION 1..186: note = MG22-75 RuvC-III domain
NDTRYIARFMKGILSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAIDAIAIACVNRSIVNYLNNAAANQTEREDLRRAVCIPERNGQTKRQLRSPWRNFAKDAENALRQIVVSFKQNLR

SEQ ID NO: 3543 - protein, 186 aa, unidentified; identical to SEQ ID NO: 3475
  REGION 1..186: note = Description of Unknown:uncultivated organism with predicted taxonomy: Bacteroidales
  REGION 1..186: note = MG22-76 RuvC-III domain

SEQ ID NO: 3544 - protein, 186 aa, unidentified; identical to SEQ ID NO: 3507
  REGION 1..186: note = Description of Unknown:uncultivated organism with predicted taxonomy: Prevotella
  REGION 1..186: note = MG22-77 RuvC-III domain

SEQ ID NO: 3545 - protein, 186 aa, unidentified; identical to SEQ ID NO: 3492
  REGION 1..186: note = Description of Unknown:uncultivated organism with predicted taxonomy: Bacteroidales
  REGION 1..186: note = MG22-78 RuvC-III domain

SEQ ID NO: 3546 - protein, 186 aa, unidentified
  REGION 1..186: note = Description of Unknown:uncultivated organism with predicted taxonomy: Bacteroidales
  REGION 1..186: note = MG22-79 RuvC-III domain
NDTRYIARFMKGILSNIVREKNTDGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDTENALRQIVVSFKQNLR

SEQ ID NO: 3547 - protein, 186 aa, unidentified
  REGION 1..186: note = Description of Unknown:uncultivated organism with predicted taxonomy: Bacteroidales
  REGION 1..186: note = MG22-80 RuvC-III domain
NDTRYIARFMKGILSNIVREKNADGTLEPEETSKNLIVCSGRITDSVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLR

SEQ ID NO: 3548 - protein, 185 aa, unidentified; identical to SEQ ID NO: 3520
  REGION 1..185: note = Description of Unknown:uncultivated organism with predicted taxonomy: Bacteroidales
  REGION 1..185: note = MG22-81 RuvC-III domain

SEQ ID NO: 3549 - protein, 186 aa, unidentified; identical to SEQ ID NO: 3533
  REGION 1..186: note = Description of Unknown:uncultivated organism with predicted taxonomy: Prevotella
  REGION 1..186: note = MG22-82 RuvC-III domain

SEQ ID NO: 3550 - protein, 186 aa, unidentified
  REGION 1..186: note = Description of Unknown:uncultivated organism with predicted taxonomy: Prevotella
  REGION 1..186: note = MG22-83 RuvC-III domain
NDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3551 - protein, 186 aa, unidentified
  REGION 1..186: note = Description of Unknown:uncultivated organism with predicted taxonomy: Bacteroidales
  REGION 1..186: note = MG22-84 RuvC-III domain
NDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDTENALRQIVVSFKQNLR

SEQ ID NO: 3552 - protein, 186 aa, unidentified
  REGION 1..186: note = Description of Unknown:uncultivated organism with predicted taxonomy: Prevotella
  REGION 1..186: note = MG22-85 RuvC-III domain
NDTRYIARFMKGILSNIVREKNADGTLEPEETSKNLIVCSGRITDRVKQDWGLNDIWNHIITQRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3553 - protein, 186 aa, unidentified; identical to SEQ ID NO: 3491
  REGION 1..186: note = Description of Unknown:uncultivated organism with predicted taxonomy: Bacteroidales
  REGION 1..186: note = MG22-86 RuvC-III domain

SEQ ID NO: 3554 - protein, 157 aa, unidentified
  REGION 1..157: note = Description of Unknown:uncultivated organism with predicted taxonomy: Prevotella sp.MGM2
  REGION 1..157: note = MG22-87 RuvC-III domain
NDTRYIARFMKGILSNIVREKNADGTLEPEETSKNLIVCSGRITDRVKQDWGLNDIWNHIVTPRFERLNTKTSSNDFGEYVCKEGKQYFQTRVPLNLQKGFNKKRIDHRHHAMDAIAIACVNRSIVNYLNNAAANQIEREALRRAVCIPERNGQTKR

SEQ ID NO: 3555 - protein, 186 aa, unidentified; identical to SEQ ID NO: 3522
  REGION 1..186: note = Description of Unknown:uncultivated organism with predicted taxonomy: Prevotella sp.MGM2
  REGION 1..186: note = MG22-88 RuvC-III domain

SEQ ID NO: 3556 - protein, 186 aa, unidentified; identical to SEQ ID NO: 3491
  REGION 1..186: note = Description of Unknown:uncultivated organism with predicted taxonomy: Prevotella sp.MGM2
  REGION 1..186: note = MG22-89 RuvC-III domain

SEQ ID NO: 3557 - protein, 186 aa, unidentified
  REGION 1..186: note = Description of Unknown:uncultivated organism with predicted taxonomy: Bacteroidales
  REGION 1..186: note = MG22-90 RuvC-III domain
NDTRYIARFMKGILSNIVREKNTDGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLR

SEQ ID NO: 3558 - protein, 186 aa, unidentified
  REGION 1..186: note = Description of Unknown:uncultivated organism with predicted taxonomy: Prevotella
  REGION 1..186: note = MG22-91 RuvC-III domain
NDTRYIVRFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3559 - protein, 186 aa, unidentified; identical to SEQ ID NO: 3485
  REGION 1..186: note = Description of Unknown:uncultivated organism with predicted taxonomy: Bacteroidales
  REGION 1..186: note = MG22-92 RuvC-III domain

SEQ ID NO: 3560 - protein, 8 aa, unidentified
  REGION 1..8: note = Description of Unknown:uncultivated organism with predicted taxonomy: Bacteroides
  REGION 1..8: note = MG22-93 RuvC-III domain
ISMKSTWR

SEQ ID NO: 3561 - protein, 184 aa, unidentified
  REGION 1..184: note = Description of Unknown:uncultivated organism with predicted taxonomy: Prevotella
  REGION 1..184: note = MG22-94 RuvC-III domain
NDTRYISRYIIGELSKLVREEKPDGTLEQEPTSKNVVVLNGSVTDKLKKDWGLVDVWNEIITPRFRRLNEMEGSQRFGQDAEKGGKRYFQITMPLELQRGFQRKRIDHRHHAMDAITIACATRQVINYLNNDHSHAGQGREDLHRAVCRKRGSEWFIRKPWDTFTQDAHARLNQIVISFKQNLR

SEQ ID NO: 3562 - protein, 196 aa, unidentified
  REGION 1..196: note = Description of Unknown:uncultivated organism with predicted taxonomy: Bacteroidales
  REGION 1..196: note = MG22-95 RuvC-III domain
NDTRYISKVVKSLLSNVVRERDEEGNLEAEAISKNVIVPVGAMTDRLKQDWGLKDVWNQLMLPRFRALNDKMAPYRFTKITRRGHEIPAMPLELVKGFSKKRIDHRHHAMDAIAIACTTRRHIQYINGDAGEAEADKSKYIDKQRVIDARRTIRNKIAHRLDGDGKPIFDKPWTTFTEDVKRALENLIVSFKQTNK

SEQ ID NO: 3563 - protein, 187 aa, unidentified
  REGION 1..187: note = Description of Unknown:uncultivated organism with predicted taxonomy: Bacteroidales
  REGION 1..187: note = MG22-96 RuvC-III domain
NDSRYISKLMIGLLSNIVREETDGHLEEEAISKNLIVCTGKVTERLKQDWGLKDVWNEIIRPRFERLNQMEQTERFGHWENKQGKNVFQITIPIELSSSVDRKRIDHRHHAMDAITIACATRNMVNYLSNQASGKTRFDLQHALCIKQKMDAQGNYKWLIRKPWQTFTEDAKTALNEIVVSFKQNLR

SEQ ID NO: 3564 - protein, 187 aa, unidentified
  REGION 1..187: note = Description of Unknown:uncultivated organism with predicted taxonomy: Bacteroidetes
  REGION 1..187: note = MG22-97 RuvC-III domain
NDSRYISKLMIGLLSNIVREDADGQLEEEAISKNLIVCTGKVTERLKQDWGLKDVWNEIIRPRFERLNHMEQSERFGHWENKQGKNVFQITIPLELSSSVDRKRIDHRHHAMDAITIACATRNMVNYLSNQASGKARYDLQHVLCVKQKMDAQGNYKWLIRKPWQTFTEDAKAAIKEIVVSFKQNLR

SEQ ID NO: 3565 - protein, 69 aa, unidentified
  REGION 1..69: note = Description of Unknown:uncultivated organism with predicted taxonomy: Bacteroidales
  REGION 1..69: note = MG22-98 RuvC-III domain
TDTQYIASTMMRLLSNIVREQDPDGSLEREVRSKNPIVCTGGITDKLKKDWGVNDAWNRIILPRFKRMD

SEQ ID NO: 3566 - protein, 196 aa, unidentified
  REGION 1..196: note = Description of Unknown:uncultivated organism with predicted taxonomy:Flavobacteriales
  REGION 1..196: note = MG22-99 RuvC-III domain
NNTRYISRLVMTILSNIVRDDREDGKSDEGIRANRLITCQGGVTDKLKKDWHVNDVWNRIILPRYERMQNEVMKGVTFVTNNSRGHEIPTMPDKLKTEEYNPKRIDHRHHAMDAIVIACATRSIVNFLNNESARDEASEGSEKAKARQTYAELRSLLCVKDADNDEKVIRKPWENFEVDVLKALEDIVVSTKHKQR

SEQ ID NO: 3567 - protein, 184 aa, unidentified
  REGION 1..184: note = Description of Unknown:uncultivated organism with predicted taxonomy: Bacteroidales
  REGION 1..184: note = MG22-100 RuvC-III domain
NDTRYIARFIMGELSKLVRQQNADGTYEEEATSKNVIVLNGAITDKLKKDWGLVDVWNGIIAERFKRLNQMEGGTRFGHEENKDGKRYFQIEMPLELQRGFNRKRIDHRHHAMDAIVIACATRAVVNYLNNDHAHDGAGREDVKRAVSRKRDQTWLINKPWPTFTEEAKEELKQMVVSFKQNLR

SEQ ID NO: 3568 - protein, 184 aa, unidentified
  REGION 1..184: note = Description of Unknown:uncultivated organism with predicted taxonomy: Bacteroidales
  REGION 1..184: note = MG22-101 RuvC-III domain
NDTRYISRFIIGELSKLVREHNPDGTLEQEAVSKNILILNGAVTDKLKKDWGLVDVWNGIIAPRFRRLNAMEGSQRFGHEAMKDGKRYFQIEMPLELQRGFQRKRIDHRHHAMDAIAIACATRNVVNYLNNDHSHEGAGREDIKRAVSSKRSGQWLVNKPWSTFTQEARKQLQQIVVSFKQNLR

SEQ ID NO: 3569 - protein, 139 aa, unidentified
  REGION 1..139: note = Description of Unknown:uncultivated organism with predicted taxonomy: Clostridia
  REGION 1..139: note = MG23-1 RuvC-III domain
VETRQGTKAIADILKQALPDTEIVYVKAGLVSDFRQKFELYKVRALNDTHHAKDAYLNIVVGNTYSTKFTNNPLNFIKAGAKRPQDNQFKYNMDKIFDYNVISRGERAWIAGSDGSICTVKKFMSRNTVLITRKAKEVH

SEQ ID NO: 3570 - protein, 143 aa, unidentified
  REGION 1..143: note = Description of Unknown:uncultivated organism with predicted taxonomy: Firmicutes
  REGION 1..143: note = MG23-3 RuvC-III domain
VETRQGTKAITKILQQAFPDDDMEVVFTKAGVAAKLRHDFDLVKVRCVNDTHHAHDAYLNIVAGNVYNAKFTSNPLRFIKNEVKKGNASYHMDKIFFRDVKRGNKLVWQAPNNEEKTPGTIAIVREQLARRTVLQTRRSYMAH

SEQ ID NO: 3571 - protein, 142 aa, unidentified
  REGION 1..142: note = Description of Unknown:uncultivated organism with predicted taxonomy: Clostridiales
  REGION 1..142: note = MG23-4 RuvC-III domain
VETRQGTKAIIQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVH

SEQ ID NO: 3572 - protein, 143 aa, unidentified
  REGION 1..143: note = Description of Unknown:uncultivated organism with predicted taxonomy: Firmicutes
  REGION 1..143: note = MG23-5 RuvC-III domain
VETRQGTKAITQILKRVFKNEAVEIIFTKAELISDFRRIFDLPKVRCVNSTHHAHDAYLNIVVGNVYNAKFTKHPRHFIEECQRKGSYDYNMYRMFDYDVKCGSKIVWCGSKITTCGKGTISTVKKQLQKRSVLLTKKSFMKH

SEQ ID NO: 3573 - protein, 143 aa, unidentified
  REGION 1..143: note = Description of Unknown:uncultivated organism with predicted taxonomy: Clostridiales
  REGION 1..143: note = MG23-6 RuvC-III domain
VETRQGTKAITQILKEAFKNDDTRIVFTKAEVTADFRHKYDLPKARSVNNLHHAHDAYLNIVAGNVYDAKFTSHPINFIKECRNKGVFNYNMAKVFDYNVKRGNRYVWIAQNDGMDMPLTIERVKNQLARNTILMTRRSYMAH

SEQ ID NO: 3574 - protein, 142 aa, unidentified; identical to SEQ ID NO: 3571
  REGION 1..142: note = Description of Unknown:uncultivated organism with predicted taxonomy: Clostridiales
  REGION 1..142: note = MG23-7 RuvC-III domain

SEQ ID NO: 3575 - protein, 142 aa, unidentified
  REGION 1..142: note = Description of Unknown:uncultivated organism with predicted taxonomy: Clostridiales
  REGION 1..142: note = MG23-8 RuvC-III domain
VETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVH

SEQ ID NO: 3576 - protein, 142 aa, unidentified; identical to SEQ ID NO: 3575
  REGION 1..142: note = Description of Unknown:uncultivated organism with predicted taxonomy: Clostridiales
  REGION 1..142: note = MG23-9 RuvC-III domain

SEQ ID NO: 3577 - protein, 139 aa, unidentified
  REGION 1..139: note = Description of Unknown:uncultivated organism with predicted taxonomy: Clostridiales
  REGION 1..139: note = MG23-10 RuvC-III domain
VETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVH

SEQ ID NO: 3578 - protein, 139 aa, unidentified
  REGION 1..139: note = Description of Unknown:uncultivated organism with predicted taxonomy: Butyrivibriosp. CAG:318
  REGION 1..139: note = MG23-11 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYH

SEQ ID NO: 3579 - protein, 139 aa, unidentified
  REGION 1..139: note = Description of Unknown:uncultivated organism with predicted taxonomy: Butyrivibriosp. CAG:318
  REGION 1..139: note = MG23-12 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEAN

SEQ ID NO: 3580 - protein, 139 aa, unidentified
  REGION 1..139: note = Description of Unknown:uncultivated organism with predicted taxonomy: Clostridium sp.AF36-4
  REGION 1..139: note = MG23-13 RuvC-III domain
VETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVH

SEQ ID NO: 3581 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-14 RuvC-III domain

SEQ ID NO: 3582 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-15 RuvC-III domain

SEQ ID NO: 3583 - protein, 139 aa, unidentified; identical to SEQ ID NO: 3580
  REGION 1..139: note = Description of Unknown:uncultivated organism with predicted taxonomy: Clostridium sp.AF36-4
  REGION 1..139: note = MG23-16 RuvC-III domain

SEQ ID NO: 3584 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-17 RuvC-III domain

SEQ ID NO: 3585 - protein, 139 aa, unidentified
  REGION 1..139: note = Description of Unknown:uncultivated organism with predicted taxonomy: Clostridiales
  REGION 1..139: note = MG23-18 RuvC-III domain
VETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVH

SEQ ID NO: 3586 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-19 RuvC-III domain

SEQ ID NO: 3587 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-20 RuvC-III domain

SEQ ID NO: 3588 - protein, 48 aa, unidentified
  REGION 1..48: note = Description of Unknown:uncultivated organism with predicted taxonomy: Butyrivibriosp. CAG:318
  REGION 1..48: note = MG23-21 RuvC-III domain
VETRQGTKAITQVLKQAFPNTQIVFVKAGIVSDFRKKFDINKVRALND

SEQ ID NO: 3589 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-22 RuvC-III domain

SEQ ID NO: 3590 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-23 RuvC-III domain

SEQ ID NO: 3591 - protein, 139 aa, unidentified
  REGION 1..139: note = Description of Unknown:uncultivated organism with predicted taxonomy: Clostridiales
  REGION 1..139: note = MG23-24 RuvC-III domain
VETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVH

SEQ ID NO: 3592 - protein, 139 aa, unidentified
  REGION 1..139: note = Description of Unknown:uncultivated organism with predicted taxonomy: Butyrivibriosp. CAG:318
  REGION 1..139: note = MG23-25 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYH

SEQ ID NO: 3593 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-26 RuvC-III domain

SEQ ID NO: 3594 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-27 RuvC-III domain

SEQ ID NO: 3595 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-28 RuvC-III domain

SEQ ID NO: 3596 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-29 RuvC-III domain

SEQ ID NO: 3597 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-30 RuvC-III domain

SEQ ID NO: 3598 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-31 RuvC-III domain

SEQ ID NO: 3599 - protein, 139 aa, unidentified; identical to SEQ ID NO: 3592
  REGION 1..139: note = Description of Unknown:uncultivated organism with predicted taxonomy: Butyrivibriosp. CAG:318
  REGION 1..139: note = MG23-32 RuvC-III domain

SEQ ID NO: 3600 - protein, 139 aa, unidentified; identical to SEQ ID NO: 3591
  REGION 1..139: note = Description of Unknown:uncultivated organism with predicted taxonomy: Clostridiales
  REGION 1..139: note = MG23-33 RuvC-III domain

SEQ ID NO: 3601 - protein, 139 aa, unidentified
  REGION 1..139: note = Description of Unknown:uncultivated organism with predicted taxonomy: Butyrivibriosp. CAG:318
  REGION 1..139: note = MG23-34 RuvC-III domain
VETRQGTKAISQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYH

SEQ ID NO: 3602 - protein, 139 aa, unidentified
  REGION 1..139: note = Description of Unknown:uncultivated organism with predicted taxonomy: Butyrivibriosp. CAG:318
  REGION 1..139: note = MG23-35 RuvC-III domain
VETRQGTKAITQILKQAFPNTQIVFVKAGIVSDFRKKFDINKVRALNDTHHAKDAYLNIVVGNTYYTKFTNNPMNFIKDASKNPKNDFYRYNMDKIFDYNVIRNGEEAWIADNGKTKQHVLRIMKKNSVTITVKTEEYH

SEQ ID NO: 3603 - protein, 139 aa, unidentified; identical to SEQ ID NO: 3591
  REGION 1..139: note = Description of Unknown:uncultivated organism with predicted taxonomy: Clostridiales
  REGION 1..139: note = MG23-36 RuvC-III domain

SEQ ID NO: 3604 - protein, 139 aa, unidentified; identical to SEQ ID NO: 3591
  REGION 1..139: note = Description of Unknown:uncultivated organism with predicted taxonomy: Clostridiales
  REGION 1..139: note = MG23-37 RuvC-III domain

SEQ ID NO: 3605 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-38 RuvC-III domain

SEQ ID NO: 3606 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-39 RuvC-III domain

SEQ ID NO: 3607 - protein, 139 aa, unidentified; identical to SEQ ID NO: 3592
  REGION 1..139: note = Description of Unknown:uncultivated organism with predicted taxonomy: Butyrivibriosp. CAG:318
  REGION 1..139: note = MG23-40 RuvC-III domain

SEQ ID NO: 3608 - protein, 139 aa, unidentified; identical to SEQ ID NO: 3591
  REGION 1..139: note = Description of Unknown:uncultivated organism with predicted taxonomy: Clostridiales
  REGION 1..139: note = MG23-41 RuvC-III domain

SEQ ID NO: 3609 - protein, 139 aa, unidentified; identical to SEQ ID NO: 3592
  REGION 1..139: note = Description of Unknown:uncultivated organism with predicted taxonomy: Butyrivibriosp. CAG:318
  REGION 1..139: note = MG23-42 RuvC-III domain

SEQ ID NO: 3610 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-43 RuvC-III domain

SEQ ID NO: 3611 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-44 RuvC-III domain

SEQ ID NO: 3612 - protein, 97 aa, unidentified
  REGION 1..97: note = Description of Unknown:uncultivated organism with predicted taxonomy: Butyrivibriosp. CAG:318
  REGION 1..97: note = MG23-45 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIF

SEQ ID NO: 3613 - protein, 139 aa, unidentified; identical to SEQ ID NO: 3591
  REGION 1..139: note = Description of Unknown:uncultivated organism with predicted taxonomy: Clostridiales
  REGION 1..139: note = MG23-46 RuvC-III domain

SEQ ID NO: 3614 - protein, 139 aa, unidentified; identical to SEQ ID NO: 3592
  REGION 1..139: note = Description of Unknown:uncultivated organism with predicted taxonomy: Butyrivibriosp. CAG:318
  REGION 1..139: note = MG23-47 RuvC-III domain

SEQ ID NO: 3615 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-48 RuvC-III domain

SEQ ID NO: 3616 - protein, 33 aa, unidentified
  REGION 1..33: note = Description of Unknown:uncultivated organism with predicted taxonomy: Clostridiales
  REGION 1..33: note = MG23-49 RuvC-III domain
VETGQGTKVITQILKQAFPDTQVVFVKARMVSD

SEQ ID NO: 3617 - protein, 139 aa, unidentified
  REGION 1..139: note = Description of Unknown:uncultivated organism with predicted taxonomy: Clostridiales
  REGION 1..139: note = MG23-50 RuvC-III domain
VETRQGTKAVTQILKQAFPDTQIIFVKAGVVSDFRKKFNINKVRALNDTHHAKDAYLNIVVGNIYNTKFTSNPINFIKDARKNVNDISYKYNMDKMFDYNVCRNGENAWIADNGKSKQHVLSVLGKNSVIITRKTEENH

SEQ ID NO: 3618 - protein, 139 aa, unidentified; identical to SEQ ID NO: 3591
  REGION 1..139: note = Description of Unknown:uncultivated organism with predicted taxonomy: Clostridiales
  REGION 1..139: note = MG23-51 RuvC-III domain

SEQ ID NO: 3619 - protein, 139 aa, unidentified; identical to SEQ ID NO: 3592
  REGION 1..139: note = Description of Unknown:uncultivated organism with predicted taxonomy: Butyrivibriosp. CAG:318
  REGION 1..139: note = MG23-52 RuvC-III domain

SEQ ID NO: 3620 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-53 RuvC-III domain

SEQ ID NO: 3621 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-54 RuvC-III domain

SEQ ID NO: 3622 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-55 RuvC-III domain

SEQ ID NO: 3623 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-56 RuvC-III domain

SEQ ID NO: 3624 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-57 RuvC-III domain

SEQ ID NO: 3625 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-58 RuvC-III domain

SEQ ID NO: 3626 - protein, 139 aa, unidentified; identical to SEQ ID NO: 3580
  REGION 1..139: note = Description of Unknown:uncultivated organism with predicted taxonomy: Clostridiales
  REGION 1..139: note = MG23-59 RuvC-III domain

SEQ ID NO: 3627 - protein, 139 aa, unidentified; identical to SEQ ID NO: 3585
  REGION 1..139: note = Description of Unknown:uncultivated organism with predicted taxonomy: Clostridiales
  REGION 1..139: note = MG23-60 RuvC-III domain

SEQ ID NO: 3628 - protein, 139 aa, unidentified; identical to SEQ ID NO: 3601
  REGION 1..139: note = Description of Unknown:uncultivated organism with predicted taxonomy: Butyrivibriosp. CAG:318
  REGION 1..139: note = MG23-62 RuvC-III domain

SEQ ID NO: 3629 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-63 RuvC-III domain

SEQ ID NO: 3630 - protein, 139 aa, unidentified; identical to SEQ ID NO: 3591
  REGION 1..139: note = Description of Unknown:uncultivated organism with predicted taxonomy: Clostridiales
  REGION 1..139: note = MG23-64 RuvC-III domain

SEQ ID NO: 3631 - protein, 139 aa, unidentified; identical to SEQ ID NO: 3577
  REGION 1..139: note = Description of Unknown:uncultivated organism with predicted taxonomy: Clostridiales
  REGION 1..139: note = MG23-65 RuvC-III domain

SEQ ID NO: 3632 - protein, 139 aa, unidentified
  REGION 1..139: note = Description of Unknown:uncultivated organism with predicted taxonomy: Butyrivibriosp. CAG:318
  REGION 1..139: note = MG23-66 RuvC-III domain
VETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWISDNGKTKQHVLRIMKKNSVTITVKTEEAH

SEQ ID NO: 3633 - protein, 139 aa, unidentified; identical to SEQ ID NO: 3579
  REGION 1..139: note = Description of Unknown:uncultivated organism with predicted taxonomy: Butyrivibriosp. CAG:318
  REGION 1..139: note = MG23-67 RuvC-III domain

SEQ ID NO: 3634 - protein, 139 aa, unidentified
  REGION 1..139: note = Description of Unknown:uncultivated organism with predicted taxonomy: Butyrivibriosp. CAG:318
  REGION 1..139: note = MG23-68 RuvC-III domain
VETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYH

SEQ ID NO: 3635 - protein, 139 aa, unidentified; identical to SEQ ID NO: 3578
  REGION 1..139: note = Description of Unknown:uncultivated organism with predicted taxonomy: Butyrivibriosp. CAG:318
  REGION 1..139: note = MG23-69 RuvC-III domain

SEQ ID NO: 3636 - protein, 139 aa, unidentified; identical to SEQ ID NO: 3592
  REGION 1..139: note = Description of Unknown:uncultivated organism with predicted taxonomy: Butyrivibriosp. CAG:318
  REGION 1..139: note = MG23-70 RuvC-III domain

SEQ ID NO: 3637 - protein, 139 aa, unidentified
  REGION 1..139: note = Description of Unknown:uncultivated organism with predicted taxonomy: Eubacterium
  REGION 1..139: note = MG23-72 RuvC-III domain
VETRQGTKAITQILKQAFPDTQIIFVKAGVVSDFRKKFNINKVRALNDTHHAKDAYLNIVVGNIYNTKFTSNPINFIKDARKNVNDVSYKYNMDKMFDYNVCRNGENAWIADNGKSKQHVLSVLGKNSVIITRKTEENH

SEQ ID NO: 3638 - protein, 162 aa, unidentified
  REGION 1..162: note = Description of Unknown:uncultivated organism with predicted taxonomy: CandidatusMelainabacteria
  REGION 1..162: note = MG1-4 HNH domain
DNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGL

SEQ ID NO: 3639 - protein, 158 aa, unidentified
  REGION 1..158: note = Description of Unknown:uncultivated organism with predicted taxonomy: Verrucomicrobia
  REGION 1..158: note = MG1-5 HNH domain
DDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDKTPFEWLSSDKTKWESYCDRVRSLTQSLGAKRCKLLVSPNAEELMQKYTAL

SEQ ID NO: 3640 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-6 HNH domain
DDFMGEKEKKEMRIAMKKRAEEKMMIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3641 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-7 HNH domain
EDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTAL

SEQ ID NO: 3642 - protein, 153 aa, unidentified
  REGION 1..153: note = Description of Unknown:uncultivated organism
  REGION 1..153: note = MG1-1 HNH domain
EDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTAL

SEQ ID NO: 3643 - protein, 151 aa, unidentified
  REGION 1..151: note = Description of Unknown:uncultivated organism with predicted taxonomy: Verrucomicrobia
  REGION 1..151: note = MG1-2 HNH domain
EDFMGEKAKIEYRKFLNRREKERKEAREQAGQLGATSGSSGLKMELFKAQRGQCLYSGQRLHETKIEDYVIEHIVPRAKRGPDAVINYVLTTEELNNDKSDHIPFEWPYLKKQWDAYTQRVESCAGALGVKRVRLLVSPDAVELAQKYTAL

SEQ ID NO: 3644 - protein, 167 aa, unidentified
  REGION 1..167: note = Description of Unknown:uncultivated organism
  REGION 1..167: note = MG1-3 HNH domain
DPPRNARQRAERQKEIEANREKREKLFEQYGIEDSGVASKRRRIMLYEQQRGKCPYTGRDLPSNPLDPSLEIEHIFPVEMGGLSVDDNLVLTWRSVNAEKGKRTPLQWAGERFDAMLANTRDMRWSARKREIFAWGTIREDKPDKPSHYNADGTLRVPDFGNTTRTA

SEQ ID NO: 3645 - protein, 167 aa, unidentified; identical to SEQ ID NO: 3644
  REGION 1..167: note = Description of Unknown:uncultivated organism
  REGION 1..167: note = MG1-13 HNH domain

SEQ ID NO: 3646 - protein, 153 aa, unidentified
  REGION 1..153: note = Description of Unknown:uncultivated organism
  REGION 1..153: note = MG1-8 HNH domain
EDFMGEQAKRELQTFQKRREQARAEAEAEAAKLGLESRSSALRYELFKAQGGICLYTGRPLSETQLDQYEIDHIVPRSLGGPDAMVNYVLTFPEVNSAKEKGKLTPYALLHGTDGWDAYVARVKARAAALRNKKVQLLTREDAPELVERYTAL

SEQ ID NO: 3647 - protein, 160 aa, unidentified
  REGION 1..160: note = Description of Unknown:uncultivated organism with predicted taxonomy: Verrucomicrobia
  REGION 1..160: note = MG1-9 HNH domain
DDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTAL

SEQ ID NO: 3648 - protein, 166 aa, unidentified
  REGION 1..166: note = Description of Unknown:uncultivated organism
  REGION 1..166: note = MG1-10 HNH domain
QAPRTETQKKEIEVEQKNNRASKDKMASEFGVGEGKLGRSKYFRIALWKQQGGSKTTKAICPFTGKTLDVDDPLSPQLELAHLYPDTKGGLYMMDNLVLTTREVNKAMDNMTPVEAARAGIFGISCDEMIRRSEQFAWGESKRKLFRFEPTAEESFPDFNNMTRIS

SEQ ID NO: 3649 - protein, 166 aa, unidentified
  REGION 1..166: note = Description of Unknown:uncultivated organism
  REGION 1..166: note = MG1-11 HNH domain
NPACNTKQASEIQKQNDARRKRKEELCRAYGCANPTHAEMLRLQLFEEQGGKRKGEAPAICPFTGESLGTDPLSPHLELAHIFPDARGGLYIRENLVLTTARTNRDMNNRTPIEAAEASLPGWSRWETIEQRIRHFRWNAKKLELFTFRPTPEQPIPDFNNMTRTA

SEQ ID NO: 3650 - protein, 161 aa, unidentified
  REGION 1..161: note = Description of Unknown:uncultivated organism
  REGION 1..161: note = MG1-12 HNH domain
DMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIA

SEQ ID NO: 3651 - protein, 153 aa, unidentified; identical to SEQ ID NO: 3642
  REGION 1..153: note = Description of Unknown:uncultivated organism
  REGION 1..153: note = MG1-14 HNH domain

SEQ ID NO: 3652 - protein, 157 aa, unidentified
  REGION 1..157: note = Description of Unknown:uncultivated organism
  REGION 1..157: note = MG1-20 HNH domain
DFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGL

SEQ ID NO: 3653 - protein, 157 aa, unidentified; identical to SEQ ID NO: 3652
  REGION 1..157: note = Description of Unknown:uncultivated organism with predicted taxonomy: CandidatusPeregrinibacteria bacterium CG10_big_fil_rev_8_21_14_0_10_54_7
  REGION 1..157: note = MG1-21 HNH domain

SEQ ID NO: 3654 - protein, 157 aa, unidentified; identical to SEQ ID NO: 3652
  REGION 1..157: note = Description of Unknown:uncultivated organism with predicted taxonomy: CandidatusPeregrinibacteria bacterium CG10_big_fil_rev_8_21_14_0_10_54_7
  REGION 1..157: note = MG1-22 HNH domain

SEQ ID NO: 3655 - protein, 155 aa, unidentified
  REGION 1..155: note = Description of Unknown:uncultivated organism with predicted taxonomy: CandidatusMelainabacteria bacterium
  REGION 1..155: note = MG1-23 HNH domain
DNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGL

SEQ ID NO: 3656 - protein, 155 aa, unidentified
  REGION 1..155: note = Description of Unknown:uncultivated organism
  REGION 1..155: note = MG1-24 HNH domain
DNSLFGKAKAQAAETNMREMEKRNQQLIEELKNYDAYSSKNFEKLKLLKIQCGQCAYSGEKIGIGDFNKCEIDHIYPRAMGGNDALYNKVLCYRVENQKKQDRTPYEWLSSNKEQWANYVFRLNKIKQSLGKKKFELLTSKPEDCAKLIDSYNGL

SEQ ID NO: 3657 - protein, 155 aa, unidentified
  REGION 1..155: note = Description of Unknown:uncultivated organism
  REGION 1..155: note = MG1-25 HNH domain
DNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGL

SEQ ID NO: 3658 - protein, 162 aa, unidentified
  REGION 1..162: note = Description of Unknown:uncultivated organism
  REGION 1..162: note = MG1-26 HNH domain
DNSLYGSKKAQDTEKYMKQQEKENEQIIKELKEAGLYVNGQNHANATYFLMHKLLKSQGGACAYSGQKIAPSNYDECEIDHIYPRTLGGNDALYNKVVCYRRENQDKKGRTPYEWLSSDNDKWANYVNRLNKIKKQLGKKKFELLTSKPEDCEKLIESYNGL

SEQ ID NO: 3659 - protein, 155 aa, unidentified
  REGION 1..155: note = Description of Unknown:uncultivated organism
  REGION 1..155: note = MG1-27 HNH domain
DNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGL

SEQ ID NO: 3660 - protein, 155 aa, unidentified
  REGION 1..155: note = Description of Unknown:uncultivated organism
  REGION 1..155: note = MG1-28 HNH domain
DNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGL

SEQ ID NO: 3661 - protein, 155 aa, unidentified; identical to SEQ ID NO: 3656
  REGION 1..155: note = Description of Unknown:uncultivated organism
  REGION 1..155: note = MG1-29 HNH domain

SEQ ID NO: 3662 - protein, 155 aa, unidentified; identical to SEQ ID NO: 3660
  REGION 1..155: note = Description of Unknown:uncultivated organism
  REGION 1..155: note = MG1-30 HNH domain

SEQ ID NO: 3663 - protein, 155 aa, unidentified; identical to SEQ ID NO: 3659
  REGION 1..155: note = Description of Unknown:uncultivated organism
  REGION 1..155: note = MG1-31 HNH domain

SEQ ID NO: 3664 - protein, 155 aa, unidentified
  REGION 1..155: note = Description of Unknown:uncultivated organism
  REGION 1..155: note = MG1-32 HNH domain
DNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSNPENCKELIKSYNGL

SEQ ID NO: 3665 - protein, 155 aa, unidentified; identical to SEQ ID NO: 3659
  REGION 1..155: note = Description of Unknown:uncultivated organism
  REGION 1..155: note = MG1-33 HNH domain

SEQ ID NO: 3666 - protein, 162 aa, unidentified; identical to SEQ ID NO: 3658
  REGION 1..162: note = Description of Unknown:uncultivated organism with predicted taxonomy: CandidatusGastranaerophilales bacterium HUM_9
  REGION 1..162: note = MG1-34 HNH domain

SEQ ID NO: 3667 - protein, 155 aa, unidentified; identical to SEQ ID NO: 3657
  REGION 1..155: note = Description of Unknown:uncultivated organism
  REGION 1..155: note = MG1-35 HNH domain

SEQ ID NO: 3668 - protein, 157 aa, unidentified
  REGION 1..157: note = Description of Unknown:uncultivated organism with predicted taxonomy: Clostridium
  REGION 1..157: note = MG1-36 HNH domain
ELGKGKSEREKIKKQKQENLGKTSRIKEELQAQGIENPTGTEITKYKLWKEQTNYCMYSGKKIDIEQVFSSETQINYIIPFWMCFDDTYKNKILTFTSEVKQKQDLMPYQYIQKMRRDTEEYETRISMLIRVYSKKNRLVKKNITKEEMIKWRNRNI

SEQ ID NO: 3669 - protein, 155 aa, unidentified; identical to SEQ ID NO: 3657
  REGION 1..155: note = Description of Unknown:uncultivated organism
  REGION 1..155: note = MG1-37 HNH domain

SEQ ID NO: 3670 - protein, 155 aa, unidentified; identical to SEQ ID NO: 3655
  REGION 1..155: note = Description of Unknown:uncultivated organism with predicted taxonomy: CandidatusMelainabacteria bacterium
  REGION 1..155: note = MG1-38 HNH domain

SEQ ID NO: 3671 - protein, 155 aa, unidentified; identical to SEQ ID NO: 3659
  REGION 1..155: note = Description of Unknown:uncultivated organism
  REGION 1..155: note = MG1-39 HNH domain

SEQ ID NO: 3672 - protein, 155 aa, unidentified; identical to SEQ ID NO: 3664
  REGION 1..155: note = Description of Unknown:uncultivated organism
  REGION 1..155: note = MG1-40 HNH domain

SEQ ID NO: 3673 - protein, 162 aa, unidentified; identical to SEQ ID NO: 3658
  REGION 1..162: note = Description of Unknown:uncultivated organism with predicted taxonomy: CandidatusGastranaerophilales bacterium HUM_9
  REGION 1..162: note = MG1-41 HNH domain

SEQ ID NO: 3674 - protein, 155 aa, unidentified; identical to SEQ ID NO: 3659
  REGION 1..155: note = Description of Unknown:uncultivated organism
  REGION 1..155: note = MG1-42 HNH domain

SEQ ID NO: 3675 - protein, 155 aa, unidentified; identical to SEQ ID NO: 3659
  REGION 1..155: note = Description of Unknown:uncultivated organism
  REGION 1..155: note = MG1-43 HNH domain

SEQ ID NO: 3676 - protein, 155 aa, unidentified; identical to SEQ ID NO: 3660
  REGION 1..155: note = Description of Unknown:uncultivated organism
  REGION 1..155: note = MG1-44 HNH domain

SEQ ID NO: 3677 - protein, 162 aa, unidentified; identical to SEQ ID NO: 3658
  REGION 1..162: note = Description of Unknown:uncultivated organism with predicted taxonomy: CandidatusMelainabacteria
  REGION 1..162: note = MG1-45 HNH domain

SEQ ID NO: 3678 - protein, 155 aa, unidentified; identical to SEQ ID NO: 3660
  REGION 1..155: note = Description of Unknown:uncultivated organism
  REGION 1..155: note = MG1-46 HNH domain

SEQ ID NO: 3679 - protein, 155 aa, unidentified; identical to SEQ ID NO: 3659
  REGION 1..155: note = Description of Unknown:uncultivated organism
  REGION 1..155: note = MG1-47 HNH domain

SEQ ID NO: 3680 - protein, 155 aa, unidentified
  REGION 1..155: note = Description of Unknown:uncultivated organism
  REGION 1..155: note = MG1-48 HNH domain
DNSLYGAKKANGYLKNIKENEKENNEIKKELEEANAYSPTNFEKLKLLRMQCGKCVYSGKNISINDFDSCEIDHVYPRTMGGNDALYNRVLCYSIENQNKAGRTPYEWLSSDKELWANYVARLNDIKGSLGKKKFELLTSKPEVCEKLIESYNGL

SEQ ID NO: 3681 - protein, 153 aa, unidentified
  REGION 1..153: note = Description of Unknown:uncultivated organism
  REGION 1..153: note = MG1-49 HNH domain
DNSLFGAEKAKATEQMMRINEKKNEEIRNNLSDDYSAINFLKYKLAEMQDWTCIYSGRKIEITDFDACEIDHIFPRTDDTNDALYNKVICYKEEIADKHGRTPYEWMNNNTARWQEYIMRVKSLSQKSGKTKTALLTLSPTQSEKFLEKRKAL

SEQ ID NO: 3682 - protein, 153 aa, unidentified; identical to SEQ ID NO: 3681
  REGION 1..153: note = Description of Unknown:uncultivated organism
  REGION 1..153: note = MG1-50 HNH domain

SEQ ID NO: 3683 - protein, 154 aa, unidentified
  REGION 1..154: note = Description of Unknown:uncultivated organism with predicted taxonomy: CandidatusMelainabacteria bacterium
  REGION 1..154: note = MG1-51 HNH domain
DNSLYGAQKANNYLISIKANEKENNEIKKELEDANAYSNTNFDKLKLLRMQGGRCIYSGEKIGISNFEQCDIDHIFPRSRGGNDALYNKVLCYSKENRIKGDKVPYEWLNNTENWDIYLQRTRDLKGSLGKKKFELLTSKPDQCEKLIESYNGL

SEQ ID NO: 3684 - protein, 155 aa, unidentified
  REGION 1..155: note = Description of Unknown:uncultivated organism
  REGION 1..155: note = MG1-52 HNH domain
DNSLYGAKKSNDYLKNIKENEKENLEIKKELEDVDRYSPTNFEKLKLLRMQGGKCIYSGKPICIDDFDKCEIDHIYPRTMGGNDALYNRVLCYSIENQNKKGRTPYEWLSNDKEYWSAYVDRLNKIKGSLGKKKFELLTSKPEDCEKLIESYNGL

SEQ ID NO: 3685 - protein, 153 aa, unidentified; identical to SEQ ID NO: 3681
  REGION 1..153: note = Description of Unknown:uncultivated organism
  REGION 1..153: note = MG1-53 HNH domain

SEQ ID NO: 3686 - protein, 153 aa, unidentified; identical to SEQ ID NO: 3681
  REGION 1..153: note = Description of Unknown:uncultivated organism
  REGION 1..153: note = MG1-54 HNH domain

SEQ ID NO: 3687 - protein, 153 aa, unidentified; identical to SEQ ID NO: 3681
  REGION 1..153: note = Description of Unknown:uncultivated organism
  REGION 1..153: note = MG1-55 HNH domain

SEQ ID NO: 3688 - protein, 155 aa, unidentified
  REGION 1..155: note = Description of Unknown:uncultivated organism
  REGION 1..155: note = MG1-56 HNH domain
DNSLEGQKRAKDTENYMKAQAKENEQIKKELEEQNALSGINFEKLKLLKMQGGKCIYSGQNIGISDFDKCEIDHIYPRTMGGNDALYNRVLCYRIENQDKKGRTPYEWLSHDEEQWAAYVHRLSEIKQILGKKKFELLTSKPEDCAKIIDSYNGL

SEQ ID NO: 3689 - protein, 153 aa, unidentified
  REGION 1..153: note = Description of Unknown:uncultivated organism
  REGION 1..153: note = MG1-57 HNH domain
DNSLFGAEKAKATEQMMKNNEKKNEEIKKNLGDDYSAINFLKYKLAEMQDWKCIYSGRKIGITDFAACEIDHIFPRTDDGNDALYNKVICYKEENADKLGRTPYEWLYHNIARWQEYVTRVKSLSQKLGKTKTALLTLPPEQSEKLLEKKNAL

SEQ ID NO: 3690 - protein, 185 aa, unidentified
  REGION 1..185: note = Description of Unknown:uncultivated organism with predicted taxonomy: CandidatusTermititenax aidoneus
  REGION 1..185: note = MG1-58 HNH domain
DNSVLSGAKAEGYKLLCEQNYAKNEKLKNDLGDDFSPQNLIKLKLLESQNFQCIYSGNNIAPTDLDACEIDHIYPRTMGGNDALYNKVLCYSIENQNKKGRTPYEWFHQEKTEEEWIEYKNRCFNFLNKYPIPKKVKRRQDNHISKSIKEYYVKLSEYKLAKKKFELLTSKPEDCEKLIESYNGL

SEQ ID NO: 3691 - protein, 158 aa, unidentified
  REGION 1..158: note = Description of Unknown:uncultivated organism with predicted taxonomy: Verrucomicrobia
  REGION 1..158: note = MG1-59 HNH domain
DDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTAF

SEQ ID NO: 3692 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-60 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3693 - protein, 150 aa, unidentified
  REGION 1..150: note = Description of Unknown:uncultivated organism
  REGION 1..150: note = MG1-61 HNH domain
EGFYGEKRRKEIIFEQNKKRKENDLAFEDAKKIGLKGKDAVLKIKLHKEQGGFDIYDGNPIKDNEIDNYEIDHIVPRESGGPDSYINKVLTSRKNNEEKGKRTPYEWLKDKNYWNDYVKRIKDSKTLNDKKKTLLTSSEAVNLAEKYTQL

SEQ ID NO: 3694 - protein, 150 aa, unidentified; identical to SEQ ID NO: 3693
  REGION 1..150: note = Description of Unknown:uncultivated organism with predicted taxonomy:Deltaproteobacteria
  REGION 1..150: note = MG1-62 HNH domain

SEQ ID NO: 3695 - protein, 160 aa, unidentified
  REGION 1..160: note = Description of Unknown:uncultivated organism with predicted taxonomy: Verrucomicrobiabacterium 61-8
  REGION 1..160: note = MG1-63 HNH domain
DDKDNSLEGRKRTEAIQQALRENEQRRDKARKALEQCGLPTTDDMVVRWLLLEAQGPACIYTNKPIRCTDLPNLQIEHIVPRALGGPDAFWNWVLSDENANAEKGDRVPYVWFKEEKTDEEWADYKRRVLARAAHLGRRKVDLLLRPDAAELAGEKYTAL

SEQ ID NO: 3696 - protein, 160 aa, unidentified
  REGION 1..160: note = Description of Unknown:uncultivated organism
  REGION 1..160: note = MG1-64 HNH domain
DDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAQLGRRKADLHLRPDAAELAGEKYTAL

SEQ ID NO: 3697 - protein, 175 aa, unidentified
  REGION 1..175: note = Description of Unknown:uncultivated organism with predicted taxonomy: Verrucomicrobia
  REGION 1..175: note = MG1-65 HNH domain
EDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETL

SEQ ID NO: 3698 - protein, 163 aa, unidentified
  REGION 1..163: note = Description of Unknown:uncultivated organism
  REGION 1..163: note = MG1-66 HNH domain
ETLDSKGRKERYKKVQDANRKAKEEAKKNLRELRNNGISIDGENALLKVRLWQEQNGRDLYTGLPIGQTEISICEIDHIIPREMGGPNAMYNFVLTKPECNREKGKRTPYQWLGSDPEKWQMFVDRINSEEYKKLSDRKKELLLKTITDEDELKELVEKYTHL

SEQ ID NO: 3699 - protein, 160 aa, unidentified
  REGION 1..160: note = Description of Unknown:uncultivated organism
  REGION 1..160: note = MG1-67 HNH domain
DDKDNSLEGRKRTEAIQQALRENEQRRDKARKALEQCGLPTTDDMVVRWLLLEAQGPACIYTNKPIRCTDLPNLQIEHIVPRSFGGPDAFWNWVLCDENANAEKGDRVPYVWFKEEKTDEEWADYKRRVLARAAQLGRRKVDLLLRPDAAELAGEKYTAL

SEQ ID NO: 3700 - protein, 150 aa, unidentified
  REGION 1..150: note = Description of Unknown:uncultivated organism with predicted taxonomy: Elusimicrobiabacterium HGW-Elusimicrobia-1
  REGION 1..150: note = MG1-68 HNH domain
DGFYGKIKKKKIIAEQNKNRKESDLAFKEAQTLGLKGGESILKIKLYREQGGFDLYDGKTIKDTEIDNYEIDHIVPREDGGPDSYINKVLTSRKNNDDKGKRTPYEWLSKSDNWEEYFERVKKLPKDSKKKKDLLVSANAKELVEKYTQL

SEQ ID NO: 3701 - protein, 168 aa, unidentified
  REGION 1..168: note = Description of Unknown:uncultivated organism with predicted taxonomy: Pedosphaera sp.Tous-C6FEB
  REGION 1..168: note = MG1-69 HNH domain
EDFMGEEAKRRLQTFQRQREEERKKARSIAAQAGAESALSALKCQLWEAQGGECLNGREVLDQTGQSKARCLYRQTALPLSRLDEYVIDHIVPRARGGPEAMVNYVLTTAETNEAKGDRTPFEWLHGSPDWDAYVARVKARAAALRNKKVQLLTREDAPELVERYTAL

SEQ ID NO: 3702 - protein, 158 aa, unidentified
  REGION 1..158: note = Description of Unknown:uncultivated organism with predicted taxonomy: Endomicrobium
  REGION 1..158: note = MG1-70 HNH domain
ETLETSKRKDYKKIQKFNLKAKEKAKQILEELRSKGISMQGSNKVLKVRLWQEQGGFDVYTGQPIGETEIDICEIDHIVPREMGGPNARYNMVLTKPECNREKGKRTPYQWLGQDPEEWQKFVERLEREKGFENLPAKKKNLLVATNPEELIERYTHL

SEQ ID NO: 3703 - protein, 175 aa, unidentified; identical to SEQ ID NO: 3697
  REGION 1..175: note = Description of Unknown:uncultivated organism
  REGION 1..175: note = MG1-71 HNH domain

SEQ ID NO: 3704 - protein, 153 aa, unidentified
  REGION 1..153: note = Description of Unknown:uncultivated organism with predicted taxonomy:Deltaproteobacteria
  REGION 1..153: note = MG1-72 HNH domain
EDFMGEQAKRELQTFQKRREQARAEAEAEAAKLGLESRSSSLRYELFKAQGGICLYTGRTLSETQLDQYEIDHIVPRSLGGPDAMVNYVLTFPEVNSAKEKGKLTPYALLHGTDGWDAYVARVKARAAALRNKKVQLLTREDAPQLVERYTAL

SEQ ID NO: 3705 - protein, 160 aa, unidentified; identical to SEQ ID NO: 3647
  REGION 1..160: note = Description of Unknown:uncultivated organism with predicted taxonomy: Pedosphaera sp.Tous-C6FEB
  REGION 1..160: note = MG1-73 HNH domain

SEQ ID NO: 3706 - protein, 175 aa, unidentified; identical to SEQ ID NO: 3697
  REGION 1..175: note = Description of Unknown:uncultivated organism
  REGION 1..175: note = MG1-74 HNH domain

SEQ ID NO: 3707 - protein, 153 aa, unidentified
  REGION 1..153: note = Description of Unknown:uncultivated organism
  REGION 1..153: note = MG1-75 HNH domain
DIPRNEKERREKEQEIRKNQGRKEKLFERFNAADSAVGSAYKRVLLFDQQRGLCPYSGGELGDPLSSDLEIDHIFPRKRGGISVRENLVLTFADRNRDKGNLTPREAARKRNGWDWDEIEAATARMKWSRKKREIFEREGAGIPPLANVTRTA

SEQ ID NO: 3708 - protein, 156 aa, unidentified
  REGION 1..156: note = Description of Unknown:uncultivated organism
  REGION 1..156: note = MG1-76 HNH domain
ELLAGEERKKKYLKLQKENRQKKEKAEKIYQELKNGNVNLKGRSILLKIQLWQEQNGIDPYSGEQIPQTKINLYEIDHIVPREMGGSDAYFNKVLTSPEKNREKAKRTPYQMFKGNISDWKKYLNTIEKITNLSKKKRALLTSENPEELIERYTHL

SEQ ID NO: 3709 - protein, 137 aa, unidentified
  REGION 1..137: note = Description of Unknown:uncultivated organism
  REGION 1..137: note = MG1-77 HNH domain
EDFMGEQAKRDLQSFQKRREQARAEAEAEAAKLGLGSRSRALRYELFKAQGGICLYTGRPLSETQLDQYEIDHIVPRSLGGPDAMVNYVLTFPEVNSAKEKGKLTPYALLHGTPHWDAYVARVKARAATLRNKKVQL

SEQ ID NO: 3710 - protein, 151 aa, unidentified
  REGION 1..151: note = Description of Unknown:uncultivated organism with predicted taxonomy: Verrucomicrobia
  REGION 1..151: note = MG1-78 HNH domain
EDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRTPYEWLSQTPGWDAYVERVKERAVTLRNKKVSLLTRPDADTLVDKYTAL

SEQ ID NO: 3711 - protein, 157 aa, unidentified
  REGION 1..157: note = Description of Unknown:uncultivated organism
  REGION 1..157: note = MG1-79 HNH domain
EIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMA

SEQ ID NO: 3712 - protein, 151 aa, unidentified
  REGION 1..151: note = Description of Unknown:uncultivated organism with predicted taxonomy: Verrucomicrobia
  REGION 1..151: note = MG1-80 HNH domain
EDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRMPYEWLSQTPGWDAYVERVKERAVTLRNKKVSLLTRPDADTLVDKYTAL

SEQ ID NO: 3713 - protein, 152 aa, unidentified
  REGION 1..152: note = Description of Unknown:uncultivated organism
  REGION 1..152: note = MG1-81 HNH domain
SLALGEKNKRELLKRNKANRDQRESIRQELASRNASTSRNAILRYRLWKEALSTCPFCGDKITQEQLLRGEADIEHLVPRSVVDCNEFYNLTVGHVRCNRELKGDRTPFQAFGHTEKWPQLRDNAEKCFKGRKLEIFLSDNAEQLIEQKADL

SEQ ID NO: 3714 - protein, 151 aa, unidentified
  REGION 1..151: note = Description of Unknown:uncultivated organism
  REGION 1..151: note = MG1-82 HNH domain
EDFMGEEAKRRLRSFQRQREAERKRAREETAEAGATEKSAPLKYELLTAQGGLCLYCGQALTLKKLEQYAIDHIVPVGAQGSDALFNKVLAHQECNAAKGKQTPFEWLHGTPGWDAYVARVKARAATLRNKKVQLLTREDAPELVERYTAL

SEQ ID NO: 3715 - protein, 154 aa, unidentified
  REGION 1..154: note = Description of Unknown:uncultivated organism
  REGION 1..154: note = MG1-83 HNH domain
DIPRNQKEKKEFKDEIKANRSRKTDIIEKKYNLKLDSLSDWQVKQVLLFDQQANDDGEAFSPYTGASLGKNPLAHGLEVEHIYPERRGGISIMDNLVITWRTENQTKGDQTPWEWLGQRATAQLQKMHWNRDKRALFVREESEPPQWDNTTRMA

SEQ ID NO: 3716 - protein, 152 aa, unidentified
  REGION 1..152: note = Description of Unknown:uncultivated organism with predicted taxonomy:Coraliomargarita sp. CAG:312
  REGION 1..152: note = MG1-84 HNH domain
EDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTAL

SEQ ID NO: 3717 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-85 HNH domain

SEQ ID NO: 3718 - protein, 152 aa, unidentified
  REGION 1..152: note = Description of Unknown:uncultivated organism with predicted taxonomy:Coraliomargarita sp. CAG:312
  REGION 1..152: note = MG1-86 HNH domain
EDFMGKQAKKDLSLSMKKRFEEKIDIAKKLDDIGYKGNKMLLKMELLQKQGFACLYTGEALQETDLPVLEIEHIVPRSLGGPDAAYNYVLTSESTNKAKGNQTPYKWLSPDRDKWRAYTERVRARAAELGSKRCRLLLSENAEELINKYTAL

SEQ ID NO: 3719 - protein, 158 aa, unidentified
  REGION 1..158: note = Description of Unknown:uncultivated organism with predicted taxonomy: Verrucomicrobia
  REGION 1..158: note = MG1-87 HNH domain
DDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTAL

SEQ ID NO: 3720 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-88 HNH domain

SEQ ID NO: 3721 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-89 HNH domain

SEQ ID NO: 3722 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-90 HNH domain

SEQ ID NO: 3723 - protein, 158 aa, unidentified
  REGION 1..158: note = Description of Unknown:uncultivated organism
  REGION 1..158: note = MG1-91 HNH domain
DDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTAL

SEQ ID NO: 3724 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-92 HNH domain

SEQ ID NO: 3725 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-93 HNH domain

SEQ ID NO: 3726 - protein, 158 aa, unidentified
  REGION 1..158: note = Description of Unknown:uncultivated organism with predicted taxonomy: unclassifiedVerrucomicrobia (miscellaneous)
  REGION 1..158: note = MG1-94 HNH domain
DDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDRTPFEWLSSDKTKWESYCDRVRSLTQSLGAKRCKLLVSPNAEELMQKYTAL

SEQ ID NO: 3727 - protein, 152 aa, unidentified
  REGION 1..152: note = Description of Unknown:uncultivated organism with predicted taxonomy:Coraliomargarita sp. CAG:312
  REGION 1..152: note = MG1-95 HNH domain
EDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARATELGSKRCRLLLSENAEELINKYTAL

SEQ ID NO: 3728 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-96 HNH domain

SEQ ID NO: 3729 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-97 HNH domain

SEQ ID NO: 3730 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-98 HNH domain

SEQ ID NO: 3731 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-99 HNH domain

SEQ ID NO: 3732 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-100 HNH domain

SEQ ID NO: 3733 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-101 HNH domain
DDFLGEKAKKEYQKAINERFKEKQELAKEMDEAGYKGAKMLLKLELYKKQGGQCVYTGEALPSSEIASLEIEHIVPRSRGGPDSIYNYVLTRESTNKEKADMTPYEWLSRNADRWNAYVSRVNSLYKSLGGKRCKLLLANNAEELVDKYTAL

SEQ ID NO: 3734 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-102 HNH domain
DDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAAL

SEQ ID NO: 3735 - protein, 152 aa, unidentified; identical to SEQ ID NO: 3692
  REGION 1..152: note = Description of Unknown:uncultivated organism with predicted taxonomy: Verrucomicrobia
  REGION 1..152: note = MG1-103 HNH domain

SEQ ID NO: 3736 - protein, 152 aa, unidentified; identical to SEQ ID NO: 3716
  REGION 1..152: note = Description of Unknown:uncultivated organism with predicted taxonomy: Verrucomicrobia
  REGION 1..152: note = MG1-104 HNH domain

SEQ ID NO: 3737 - protein, 152 aa, unidentified; identical to SEQ ID NO: 3692
  REGION 1..152: note = Description of Unknown:uncultivated organism
  REGION 1..152: note = MG1-105 HNH domain

SEQ ID NO: 3738 - protein, 158 aa, unidentified
  REGION 1..158: note = Description of Unknown:uncultivated organism with predicted taxonomy: Verrucomicrobia
  REGION 1..158: note = MG1-106 HNH domain
DDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWLSSKGAEWDSYCDRVRELTKNLGAKRCRLLLAPNAAELVEKYTAL

SEQ ID NO: 3739 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-107 HNH domain

SEQ ID NO: 3740 - protein, 158 aa, unidentified
  REGION 1..158: note = Description of Unknown:uncultivated organism with predicted taxonomy: Verrucomicrobia
  REGION 1..158: note = MG1-108 HNH domain
DDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTAL

SEQ ID NO: 3741 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-109 HNH domain
DDFMGEKEKKEMRSAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3742 - protein, 158 aa, unidentified
  REGION 1..158: note = Description of Unknown:uncultivated organism with predicted taxonomy: Verrucomicrobia
  REGION 1..158: note = MG1-110 HNH domain
DDFLGKKAKSDLNKAIKTRFDEKKKLAEDLDSKREEFGFKYASKKMLLKFELYKKQGGECVYTGKALPLSELESLEIEHIVPRSRGGPDAMYNYVLTDEKTNKEKGDRTPFEWRSTMGAEWESYCERVRKLTKELGAKRCKLLLSPNAAELVEKYTAL

SEQ ID NO: 3743 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-111 HNH domain

SEQ ID NO: 3744 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-112 HNH domain

SEQ ID NO: 3745 - protein, 152 aa, unidentified
  REGION 1..152: note = Description of Unknown:uncultivated organism with predicted taxonomy: Verrucomicrobia
  REGION 1..152: note = MG1-113 HNH domain
EDFMGKEQKKRMQIGMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRIKARAGQLGRKRCELLLEKNAEELVEKYTAL

SEQ ID NO: 3746 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-114 HNH domain

SEQ ID NO: 3747 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-115 HNH domain

SEQ ID NO: 3748 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-116 HNH domain

SEQ ID NO: 3749 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-117 HNH domain

SEQ ID NO: 3750 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-118 HNH domain

SEQ ID NO: 3751 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-119 HNH domain

SEQ ID NO: 3752 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-120 HNH domain
EDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTAL

SEQ ID NO: 3753 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-121 HNH domain

SEQ ID NO: 3754 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-122 HNH domain

SEQ ID NO: 3755 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-123 HNH domain

SEQ ID NO: 3756 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-124 HNH domain

SEQ ID NO: 3757 - protein, 152 aa, unidentified; identical to SEQ ID NO: 3716
  REGION 1..152: note = Description of Unknown:uncultivated organism with predicted taxonomy: Verrucomicrobia
  REGION 1..152: note = MG1-125 HNH domain

SEQ ID NO: 3758 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-126 HNH domain

SEQ ID NO: 3759 - protein, 158 aa, unidentified; identical to SEQ ID NO: 3738
  REGION 1..158: note = Description of Unknown:uncultivated organism with predicted taxonomy: Verrucomicrobia
  REGION 1..158: note = MG1-127 HNH domain

SEQ ID NO: 3760 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-128 HNH domain

SEQ ID NO: 3761 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-129 HNH domain

SEQ ID NO: 3762 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-130 HNH domain

SEQ ID NO: 3763 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-131 HNH domain

SEQ ID NO: 3764 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-132 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTAL

SEQ ID NO: 3765 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-133 HNH domain

SEQ ID NO: 3766 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-134 HNH domain

SEQ ID NO: 3767 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-135 HNH domain

SEQ ID NO: 3768 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-136 HNH domain

SEQ ID NO: 3769 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-137 HNH domain

SEQ ID NO: 3770 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-138 HNH domain

SEQ ID NO: 3771 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-139 HNH domain

SEQ ID NO: 3772 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-140 HNH domain

SEQ ID NO: 3773 - protein, 158 aa, unidentified
  REGION 1..158: note = Description of Unknown:uncultivated organism with predicted taxonomy: Verrucomicrobia
  REGION 1..158: note = MG1-141 HNH domain
DDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTAL

SEQ ID NO: 3774 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-142 HNH domain
EDFMGKEQKKRMQIEMKKRASEKMLIAKKLDEAGYKGGNLLLKMELFEKQGGVCLYTGEPLLPSELGILEIEHIVPRSRGGPDAQYNYVLTREKTNKEKADRTPFEWLSSDPVRWAGYSDRVKARAGQLGRKRCELLLEKNAEELVEKYTAL

SEQ ID NO: 3775 - protein, 152 aa, unidentified
  REGION 1..152: note = Description of Unknown:uncultivated organism with predicted taxonomy: Verrucomicrobiabacterium
  REGION 1..152: note = MG1-143 HNH domain
EDFMGKEQKKRMQIEMKKRASEKMLIAKKLDEAGYKGGNLLMKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTAL

SEQ ID NO: 3776 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-144 HNH domain

SEQ ID NO: 3777 - protein, 158 aa, unidentified
  REGION 1..158: note = Description of Unknown:uncultivated organism with predicted taxonomy: Verrucomicrobia
  REGION 1..158: note = MG1-145 HNH domain
DDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLSPNAAELVEKYTAL

SEQ ID NO: 3778 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-147 HNH domain

SEQ ID NO: 3779 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-148 HNH domain

SEQ ID NO: 3780 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-149 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVTACAKALGKKRCRLLLEKDAEELVEKYTAL

SEQ ID NO: 3781 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-150 HNH domain

SEQ ID NO: 3782 - protein, 152 aa, unidentified
  REGION 1..152: note = Description of Unknown:uncultivated organism with predicted taxonomy: Verrucomicrobia
  REGION 1..152: note = MG1-151 HNH domain
EDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTAL

SEQ ID NO: 3783 - protein, 158 aa, unidentified; identical to SEQ ID NO: 3723
  REGION 1..158: note = Description of Unknown:uncultivated organism
  REGION 1..158: note = MG1-152 HNH domain

SEQ ID NO: 3784 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-153 HNH domain

SEQ ID NO: 3785 - protein, 158 aa, unidentified
  REGION 1..158: note = Description of Unknown:uncultivated organism with predicted taxonomy: Verrucomicrobia
  REGION 1..158: note = MG1-154 HNH domain
DDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPFEWRSTMGAEWESYCERVRKLTKELGAKRCKLLLSPNAAELVEKYTAL

SEQ ID NO: 3786 - protein, 158 aa, unidentified
  REGION 1..158: note = Description of Unknown:uncultivated organism with predicted taxonomy: Verrucomicrobia
  REGION 1..158: note = MG1-155 HNH domain
DDFLGKKAKADLSRAINDRAKERKKYAEELDSQREIFGSKYASKKMLLKYELYSKQKGVCVYTGNALGFSNLEQLEVEHIVPRSRGGPDALYNYVLTDEKTNKEKGDRTPFEWLSSKGLEWESYCQRVRELTKEFGAKRCRLLLSPNAEELVEKYTAL

SEQ ID NO: 3787 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-156 HNH domain

SEQ ID NO: 3788 - protein, 152 aa, unidentified
  REGION 1..152: note = Description of Unknown:uncultivated organism with predicted taxonomy: Verrucomicrobia
  REGION 1..152: note = MG1-157 HNH domain
DDFLGEKAKKEYQKAINERFKEKQELAKEMDEAGYKGAKMLLKLELYKKQGGQCVYTGEALPSSEIASLEIEHIVPRSRGGPDSIYNYVLTRERTNKEKADRTPYEWLSRDQQRWNAYVSRVNSLYKSLGGKRCKLLLANNAEELVDKYTAL

SEQ ID NO: 3789 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-158 HNH domain
EDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVTARAGQLGRKRCELLLEKNAEELVEKYTAL

SEQ ID NO: 3790 - protein, 152 aa, unidentified
  REGION 1..152: note = Description of Unknown:uncultivated organism with predicted taxonomy:Coraliomargarita sp. CAG:312
  REGION 1..152: note = MG1-159 HNH domain
DDFIGKEKKKELNIAIKKRYSEKLKIAEKLDEIGFKGSKMLMKLELFQKQGGICLYTREPLLPTEIPSLEIEHIVPRSRGGPDSAYNFVLTREATNKEKANRTPFEWLSGDSQKWVSYSDRVMSRSKELGKKRCQLLLKENAEELVEKYTAL

SEQ ID NO: 3791 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-160 HNH domain

SEQ ID NO: 3792 - protein, 158 aa, unidentified; identical to SEQ ID NO: 3723
  REGION 1..158: note = Description of Unknown:uncultivated organism with predicted taxonomy: Verrucomicrobia
  REGION 1..158: note = MG1-161 HNH domain

SEQ ID NO: 3793 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-162 HNH domain

SEQ ID NO: 3794 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-163 HNH domain
EDFMGKEQKKRMQIEMKKRASEKMLIAKKLDEAGYKGGNLLLKMELLEKQGGVCLYTGEPLLPSELGVLEIEHIVPRSRGGPDAQYNYVLPREKTNKEKADRTPFEWLSSDPVKWAGYSDRVKARAGQLGRKRCELLLEKNAEELVEKYTAL

SEQ ID NO: 3795 - protein, 158 aa, unidentified
  REGION 1..158: note = Description of Unknown:uncultivated organism with predicted taxonomy: Verrucomicrobia
  REGION 1..158: note = MG1-164 HNH domain
DDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGERTPFEWLSSDKTKWESYCDRVRSLTQSLGAKRCKLLVSPNAEELMQKYTAL

SEQ ID NO: 3796 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-165 HNH domain

SEQ ID NO: 3797 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-166 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKGLGKKRCRLLLEKDAEELVEKYTAL

SEQ ID NO: 3798 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-167 HNH domain

SEQ ID NO: 3799 - protein, 158 aa, unidentified; identical to SEQ ID NO: 3723
  REGION 1..158: note = Description of Unknown:uncultivated organism with predicted taxonomy: Verrucomicrobia
  REGION 1..158: note = MG1-168 HNH domain

SEQ ID NO: 3800 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-169 HNH domain

SEQ ID NO: 3801 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-170 HNH domain

SEQ ID NO: 3802 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-171 HNH domain
DDFMGEKEKKEMRIAMKKRAEEKMRIAKDLDEHGFKGDNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3803 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-172 HNH domain

SEQ ID NO: 3804 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-173 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACTKALGKKRCRLLLEKDAEELVEKYTAL

SEQ ID NO: 3805 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-174 HNH domain

SEQ ID NO: 3806 - protein, 158 aa, unidentified; identical to SEQ ID NO: 3719
  REGION 1..158: note = Description of Unknown:uncultivated organism with predicted taxonomy:Coraliomargarita sp. CAG:312
  REGION 1..158: note = MG1-175 HNH domain

SEQ ID NO: 3807 - protein, 152 aa, unidentified; identical to SEQ ID NO: 3734
  REGION 1..152: note = Description of Unknown:uncultivated organism with predicted taxonomy: unclassifiedVerrucomicrobia (miscellaneous)
  REGION 1..152: note = MG1-176 HNH domain

SEQ ID NO: 3808 - protein, 158 aa, unidentified; identical to SEQ ID NO: 3777
  REGION 1..158: note = Description of Unknown:uncultivated organism with predicted taxonomy: Verrucomicrobia
  REGION 1..158: note = MG1-177 HNH domain

SEQ ID NO: 3809 - protein, 152 aa, unidentified; identical to SEQ ID NO: 3790
  REGION 1..152: note = Description of Unknown:uncultivated organism with predicted taxonomy:Coraliomargarita sp. CAG:312
  REGION 1..152: note = MG1-178 HNH domain

SEQ ID NO: 3810 - protein, 158 aa, unidentified; identical to SEQ ID NO: 3773
  REGION 1..158: note = Description of Unknown:uncultivated organism with predicted taxonomy:Coraliomargarita sp. CAG:312
  REGION 1..158: note = MG1-179 HNH domain

SEQ ID NO: 3811 - protein, 152 aa, unidentified; identical to SEQ ID NO: 3764
  REGION 1..152: note = Description of Unknown:uncultivated organism with predicted taxonomy: unclassifiedVerrucomicrobia (miscellaneous)
  REGION 1..152: note = MG1-180 HNH domain

SEQ ID NO: 3812 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-181 HNH domain

SEQ ID NO: 3813 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-182 HNH domain

SEQ ID NO: 3814 - protein, 152 aa, unidentified; identical to SEQ ID NO: 3727
  REGION 1..152: note = Description of Unknown:uncultivated organism with predicted taxonomy:Coraliomargarita sp. CAG:312
  REGION 1..152: note = MG1-183 HNH domain

SEQ ID NO: 3815 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-184 HNH domain

SEQ ID NO: 3816 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-185 HNH domain

SEQ ID NO: 3817 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-186 HNH domain

SEQ ID NO: 3818 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-187 HNH domain

SEQ ID NO: 3819 - protein, 152 aa, unidentified; identical to SEQ ID NO: 3716
  REGION 1..152: note = Description of Unknown:uncultivated organism with predicted taxonomy: Verrucomicrobia
  REGION 1..152: note = MG1-188 HNH domain

SEQ ID NO: 3820 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-189 HNH domain

SEQ ID NO: 3821 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-190 HNH domain

SEQ ID NO: 3822 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-191 HNH domain

SEQ ID NO: 3823 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-192 HNH domain
DDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3824 - protein, 158 aa, unidentified; identical to SEQ ID NO: 3785
  REGION 1..158: note = Description of Unknown:uncultivated organism with predicted taxonomy: Verrucomicrobia
  REGION 1..158: note = MG1-193 HNH domain

SEQ ID NO: 3825 - protein, 152 aa, unidentified; identical to SEQ ID NO: 3764
  REGION 1..152: note = Description of Unknown:uncultivated organism with predicted taxonomy: unclassifiedVerrucomicrobia (miscellaneous)
  REGION 1..152: note = MG1-194 HNH domain

SEQ ID NO: 3826 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-195 HNH domain

SEQ ID NO: 3827 - protein, 152 aa, unidentified; identical to SEQ ID NO: 3782
  REGION 1..152: note = Description of Unknown:uncultivated organism with predicted taxonomy: Verrucomicrobia
  REGION 1..152: note = MG1-196 HNH domain

SEQ ID NO: 3828 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-197 HNH domain

SEQ ID NO: 3829 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-198 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTAL

SEQ ID NO: 3830 - protein, 152 aa, unidentified; identical to SEQ ID NO: 3829
  REGION 1..152: note = Description of Unknown:uncultivated organism with predicted taxonomy: unclassifiedVerrucomicrobia (miscellaneous)
  REGION 1..152: note = MG1-199 HNH domain

SEQ ID NO: 3831 - protein, 158 aa, unidentified
  REGION 1..158: note = Description of Unknown:uncultivated organism
  REGION 1..158: note = MG1-200 HNH domain
DDFLGKKAKSDLNKAIKTRFDEKKKLAEDLDSKREEFGFKYASKKMLLKFELYKKQGGKCVYTGNALPLSELESLEIEHIVPRSRGGPDAMYNYVLTDEKTNKEKGDRTPFEWLSTMGAEWESYCERVRKLTKELGAKRCKLLLSPNAAELVEKYTAL

SEQ ID NO: 3832 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-201 HNH domain

SEQ ID NO: 3833 - protein, 158 aa, unidentified
  REGION 1..158: note = Description of Unknown:uncultivated organism with predicted taxonomy:Coraliomargarita sp. CAG:312
  REGION 1..158: note = MG1-202 HNH domain
DDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLAPNAAELVEKYTAL

SEQ ID NO: 3834 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-203 HNH domain

SEQ ID NO: 3835 - protein, 158 aa, unidentified; identical to SEQ ID NO: 3742
  REGION 1..158: note = Description of Unknown:uncultivated organism with predicted taxonomy: Verrucomicrobia
  REGION 1..158: note = MG1-204 HNH domain

SEQ ID NO: 3836 - protein, 158 aa, unidentified; identical to SEQ ID NO: 3719
  REGION 1..158: note = Description of Unknown:uncultivated organism with predicted taxonomy:Coraliomargarita sp. CAG:312
  REGION 1..158: note = MG1-205 HNH domain

SEQ ID NO: 3837 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-206 HNH domain

SEQ ID NO: 3838 - protein, 152 aa, unidentified; identical to SEQ ID NO: 3752
  REGION 1..152: note = Description of Unknown:uncultivated organism with predicted taxonomy: unclassifiedVerrucomicrobia (miscellaneous)
  REGION 1..152: note = MG1-207 HNH domain

SEQ ID NO: 3839 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-208 HNH domain

SEQ ID NO: 3840 - protein, 152 aa, unidentified; identical to SEQ ID NO: 3741
  REGION 1..152: note = Description of Unknown:uncultivated organism with predicted taxonomy: unclassifiedVerrucomicrobia (miscellaneous)
  REGION 1..152: note = MG1-209 HNH domain

SEQ ID NO: 3841 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-210 HNH domain

SEQ ID NO: 3842 - protein, 152 aa, unidentified; identical to SEQ ID NO: 3718
  REGION 1..152: note = Description of Unknown:uncultivated organism with predicted taxonomy:Coraliomargarita sp. CAG:312
  REGION 1..152: note = MG1-211 HNH domain

SEQ ID NO: 3843 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-212 HNH domain

SEQ ID NO: 3844 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-213 HNH domain

SEQ ID NO: 3845 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-214 HNH domain

SEQ ID NO: 3846 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-215 HNH domain

SEQ ID NO: 3847 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-216 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVIIREKTNKLKGDKTPYEWLSSDAKEWASYTDRVNACAKALGKKRCRLLLEKDAEELVEKYTAL

SEQ ID NO: 3848 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-217 HNH domain

SEQ ID NO: 3849 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-218 HNH domain

SEQ ID NO: 3850 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-219 HNH domain

SEQ ID NO: 3851 - protein, 152 aa, unidentified
  REGION 1..152: note = Description of Unknown:uncultivated organism with predicted taxonomy: unclassifiedVerrucomicrobia (miscellaneous)
  REGION 1..152: note = MG1-220 HNH domain
DDFMGEKEKKEMRIAMKKRAEGKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCHLLLEKDAEELVEKYTAL

SEQ ID NO: 3852 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-221 HNH domain

SEQ ID NO: 3853 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-222 HNH domain

SEQ ID NO: 3854 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-223 HNH domain

SEQ ID NO: 3855 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-224 HNH domain

SEQ ID NO: 3856 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-225 HNH domain

SEQ ID NO: 3857 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-226 HNH domain

SEQ ID NO: 3858 - protein, 152 aa, unidentified
  REGION 1..152: note = Description of Unknown:uncultivated organism with predicted taxonomy:Coraliomargarita sp. CAG:312
  REGION 1..152: note = MG1-227 HNH domain
EDFMGKQAKKDLSLYMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTAL

SEQ ID NO: 3859 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-228 HNH domain

SEQ ID NO: 3860 - protein, 152 aa, unidentified; identical to SEQ ID NO: 3692
  REGION 1..152: note = Description of Unknown:uncultivated organism with predicted taxonomy: Verrucomicrobia
  REGION 1..152: note = MG1-229 HNH domain

SEQ ID NO: 3861 - protein, 152 aa, unidentified
  REGION 1..152: note = Description of Unknown:uncultivated organism with predicted taxonomy: Verrucomicrobia
  REGION 1..152: note = MG1-230 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTTL

SEQ ID NO: 3862 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-231 HNH domain

SEQ ID NO: 3863 - protein, 158 aa, unidentified; identical to SEQ ID NO: 3719
  REGION 1..158: note = Description of Unknown:uncultivated organism with predicted taxonomy: Verrucomicrobia
  REGION 1..158: note = MG1-232 HNH domain

SEQ ID NO: 3864 - protein, 152 aa, unidentified; identical to SEQ ID NO: 3745
  REGION 1..152: note = Description of Unknown:uncultivated organism
  REGION 1..152: note = MG1-233 HNH domain

SEQ ID NO: 3865 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-234 HNH domain

SEQ ID NO: 3866 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-236 HNH domain

SEQ ID NO: 3867 - protein, 152 aa, unidentified; identical to SEQ ID NO: 3692
  REGION 1..152: note = Description of Unknown:uncultivated organism with predicted taxonomy: Verrucomicrobia
  REGION 1..152: note = MG1-237 HNH domain

SEQ ID NO: 3868 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-238 HNH domain

SEQ ID NO: 3869 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-239 HNH domain

SEQ ID NO: 3870 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-240 HNH domain

SEQ ID NO: 3871 - protein, 152 aa, unidentified; identical to SEQ ID NO: 3716
  REGION 1..152: note = Description of Unknown:uncultivated organism with predicted taxonomy: Verrucomicrobia
  REGION 1..152: note = MG1-241 HNH domain

SEQ ID NO: 3872 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-242 HNH domain

SEQ ID NO: 3873 - protein, 158 aa, unidentified; identical to SEQ ID NO: 3786
  REGION 1..158: note = Description of Unknown:uncultivated organism with predicted taxonomy: Verrucomicrobia
  REGION 1..158: note = MG1-243 HNH domain

SEQ ID NO: 3874 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-244 HNH domain

SEQ ID NO: 3875 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-245 HNH domain

SEQ ID NO: 3876 - protein, 152 aa, unidentified; identical to SEQ ID NO: 3752
  REGION 1..152: note = Description of Unknown:uncultivated organism with predicted taxonomy: unclassifiedVerrucomicrobia (miscellaneous)
  REGION 1..152: note = MG1-246 HNH domain

SEQ ID NO: 3877 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-247 HNH domain

SEQ ID NO: 3878 - protein, 152 aa, unidentified; identical to SEQ ID NO: 3782
  REGION 1..152: note = Description of Unknown:uncultivated organism with predicted taxonomy: unclassifiedVerrucomicrobia (miscellaneous)
  REGION 1..152: note = MG1-248 HNH domain

SEQ ID NO: 3879 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-249 HNH domain

SEQ ID NO: 3880 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-250 HNH domain

SEQ ID NO: 3881 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-251 HNH domain

SEQ ID NO: 3882 - protein, 152 aa, unidentified; identical to SEQ ID NO: 3774
  REGION 1..152: note = Description of Unknown:uncultivated organism with predicted taxonomy: unclassifiedVerrucomicrobia (miscellaneous)
  REGION 1..152: note = MG1-252 HNH domain

SEQ ID NO: 3883 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-253 HNH domain

SEQ ID NO: 3884 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-254 HNH domain

SEQ ID NO: 3885 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-255 HNH domain

SEQ ID NO: 3886 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-256 HNH domain

SEQ ID NO: 3887 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-257 HNH domain

SEQ ID NO: 3888 - protein, 158 aa, unidentified; identical to SEQ ID NO: 3723
  REGION 1..158: note = Description of Unknown:uncultivated organism with predicted taxonomy: Verrucomicrobia
  REGION 1..158: note = MG1-258 HNH domain

SEQ ID NO: 3889 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-259 HNH domain

SEQ ID NO: 3890 - protein, 152 aa, unidentified; identical to SEQ ID NO: 3764
  REGION 1..152: note = Description of Unknown:uncultivated organism with predicted taxonomy: unclassifiedVerrucomicrobia (miscellaneous)
  REGION 1..152: note = MG1-260 HNH domain

SEQ ID NO: 3891 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-261 HNH domain

SEQ ID NO: 3892 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-262 HNH domain

SEQ ID NO: 3893 - protein, 152 aa, unidentified; identical to SEQ ID NO: 3788
  REGION 1..152: note = Description of Unknown:uncultivated organism with predicted taxonomy: Verrucomicrobia
  REGION 1..152: note = MG1-263 HNH domain

SEQ ID NO: 3894 - protein, 152 aa, unidentified; identical to SEQ ID NO: 3641
  REGION 1..152: note = Description of Unknown:uncultivated organism with predicted taxonomy: unclassifiedVerrucomicrobia (miscellaneous)
  REGION 1..152: note = MG1-264 HNH domain

SEQ ID NO: 3895 - protein, 152 aa, unidentified; identical to SEQ ID NO: 3794
  REGION 1..152: note = Description of Unknown:uncultivated organism with predicted taxonomy: unclassifiedVerrucomicrobia (miscellaneous)
  REGION 1..152: note = MG1-265 HNH domain

SEQ ID NO: 3896 - protein, 152 aa, unidentified; identical to SEQ ID NO: 3716
  REGION 1..152: note = Description of Unknown:uncultivated organism with predicted taxonomy:Coraliomargarita sp. CAG:312
  REGION 1..152: note = MG1-266 HNH domain

SEQ ID NO: 3897 - protein, 158 aa, unidentified; identical to SEQ ID NO: 3740
  REGION 1..158: note = Description of Unknown:uncultivated organism with predicted taxonomy: Verrucomicrobia
  REGION 1..158: note = MG1-267 HNH domain

SEQ ID NO: 3898 - protein, 152 aa, unidentified; identical to SEQ ID NO: 3692
  REGION 1..152: note = Description of Unknown:uncultivated organism with predicted taxonomy: Verrucomicrobia
  REGION 1..152: note = MG1-268 HNH domain

SEQ ID NO: 3899 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-269 HNH domain

SEQ ID NO: 3900 - protein, 152 aa, unidentified; identical to SEQ ID NO: 3733
  REGION 1..152: note = Description of Unknown:uncultivated organism with predicted taxonomy: Verrucomicrobia
  REGION 1..152: note = MG1-270 HNH domain

SEQ ID NO: 3901 - protein, 152 aa, unidentified; identical to SEQ ID NO: 3692
  REGION 1..152: note = Description of Unknown:uncultivated organism with predicted taxonomy: unclassifiedVerrucomicrobia (miscellaneous)
  REGION 1..152: note = MG1-271 HNH domain

SEQ ID NO: 3902 - protein, 183 aa, unidentified
  REGION 1..183: note = Description of Unknown:uncultivated organism
  REGION 1..183: note = MG1-272 HNH domain
ELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKL

SEQ ID NO: 3903 - protein, 185 aa, unidentified
  REGION 1..185: note = Description of Unknown:uncultivated organism with predicted taxonomy: Rhizobiales
  REGION 1..185: note = MG1-273 HNH domain
DLMMNQEQKDAKEAKDKERRKERDEAAQILRDMGFAPDADNIKKFLLAQEAGWRCPFTLRPFCQSDFSQLTVTQLIQAENKPRFVKEASSVFDRLEIEHLVPRTPVVCNEWFNLTVTLHSTNAQKRKRTPFQWLFADKDGLPADLDWERIRKNAVERFGESSLKYQVFTSPDGAKLVEDNAKKSI

SEQ ID NO: 3904 - protein, 185 aa, unidentified
  REGION 1..185: note = Description of Unknown:uncultivated organism
  REGION 1..185: note = MG1-274 HNH domain
DLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSI

SEQ ID NO: 3905 - protein, 161 aa, unidentified; identical to SEQ ID NO: 3650
  REGION 1..161: note = Description of Unknown:uncultivated organism
  REGION 1..161: note = MG1-275 HNH domain

SEQ ID NO: 3906 - protein, 151 aa, unidentified
  REGION 1..151: note = Description of Unknown:uncultivated organism with predicted taxonomy: Verrucomicrobiabacterium IMCC26134
  REGION 1..151: note = MG1-276 HNH domain
EDFMGQKAKLEYLKFQRERARARAEAREEAAKAGATENSAGLKMELHKAQGGICLYTGDGLAVTSLDDYDIDHIVPESQGGPDALLNKVLTTRLANREKANRTPYEWLASSDRWDAYVERGKKRLTTLRNKKVQLLTSPEATALVEKYTAL

SEQ ID NO: 3907 - protein, 153 aa, unidentified
  REGION 1..153: note = Description of Unknown:uncultivated organism
  REGION 1..153: note = MG1-277 HNH domain
SLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDL

SEQ ID NO: 3908 - protein, 108 aa, unidentified
  REGION 1..108: note = Description of Unknown:uncultivated organism with predicted taxonomy: Pedosphaera sp.Tous-C6FEB
  REGION 1..108: note = MG1-278 HNH domain
EDFMGEEAVKKYQRFLNDRADERKKAREEAEKLGLESRSSGLRYELFKAQGGICLYTGKSLGETSLDDYEIDHIVPRSLGVPDAALNYVLTFHDVNHAKEKGKLTPYA

SEQ ID NO: 3909 - protein, 151 aa, unidentified
  REGION 1..151: note = Description of Unknown:uncultivated organism
  REGION 1..151: note = MG1-279 HNH domain
SLALGQKAKNELNQRNEKFRKERENAREQLSSNKESFSRKAIQRYRLWQEAKGRCPFCLQMIERTELGHGADIEHLVPRSIVDCNEFYNLTVAHIKCNRELKGDRTPFAAFSGTSQWPDIKDHAEKTFFGRKLEIFLSPDAEQLIEQKSDL

SEQ ID NO: 3910 - protein, 183 aa, unidentified; identical to SEQ ID NO: 3902
  REGION 1..183: note = Description of Unknown:uncultivated organism
  REGION 1..183: note = MG1-280 HNH domain

SEQ ID NO: 3911 - protein, 153 aa, unidentified; identical to SEQ ID NO: 3907
  REGION 1..153: note = Description of Unknown:uncultivated organism with predicted taxonomy:Thermoflexibacter ruber
  REGION 1..153: note = MG1-281 HNH domain

SEQ ID NO: 3912 - protein, 153 aa, unidentified; identical to SEQ ID NO: 3907
  REGION 1..153: note = Description of Unknown:uncultivated organism
  REGION 1..153: note = MG1-282 HNH domain

SEQ ID NO: 3913 - protein, 158 aa, unidentified
  REGION 1..158: note = Description of Unknown:uncultivated organism with predicted taxonomy: Verrucomicrobiabacterium IMCC26134
  REGION 1..158: note = MG1-283 HNH domain
EDFMGEKAKRELKDFQDKREAARKKAREKATAAGSEEKSAALKFELCEAQGFICLYCGQPFATTKLNECRIEHIVPTAQGGPDAMVNYVAAHDECNEAKGKQTPFQWWHHNTSGKAPTISWDGYKALVDKYATTLRNKKVQLLTREDAVELVGRYTAL

SEQ ID NO: 3914 - protein, 153 aa, unidentified
  REGION 1..153: note = Description of Unknown:uncultivated organism
  REGION 1..153: note = MG1-284 HNH domain
SLAMGEKKRREHIQRIKENRDERESIRTELKKDNFSSSKNSILRYRLFKEAKGRCPFCLCPFCLQEVVYKEAEIEHIVPRSRVDCNEFYNLTVAHQECNKKKDSRTPWEAYGTTKDWEALRKNAEDCFGLGSLKYRLFTNPDAQNLVEEKSDL

SEQ ID NO: 3915 - protein, 153 aa, unidentified
  REGION 1..153: note = Description of Unknown:uncultivated organism with predicted taxonomy: Verrucomicrobia
  REGION 1..153: note = MG1-285 HNH domain
EDFMGKKAKIEYFSFIKRRAEERIKAREEAANAGATEKSAGLKLELLRAQDGCCLYTNEGLVPSRLDEYQIDHIVPRSKGGPDAVVNYALTTQKANEAKADRTPYDWFHQEMPDKWDAYVNRVRSRATHLRNKKVQLLVALNAAELADKYTAL

SEQ ID NO: 3916 - protein, 153 aa, unidentified; identical to SEQ ID NO: 3642
  REGION 1..153: note = Description of Unknown:uncultivated organism with predicted taxonomy: Verrucomicrobia
  REGION 1..153: note = MG1-287 HNH domain

SEQ ID NO: 3917 - protein, 153 aa, unidentified; identical to SEQ ID NO: 3642
  REGION 1..153: note = Description of Unknown:uncultivated organism
  REGION 1..153: note = MG1-288 HNH domain

SEQ ID NO: 3918 - protein, 47 aa, unidentified
  REGION 1..47: note = Description of Unknown:uncultivated organism with predicted taxonomy: Pedosphaera sp.Tous-C6FEB
  REGION 1..47: note = MG1-289 HNH domain
EDFMGEEAKREYQNFINEREKDRKAAREEAGKLGFDSRSSGLRYELW

SEQ ID NO: 3919 - protein, 151 aa, unidentified
  REGION 1..151: note = Description of Unknown:uncultivated organism with predicted taxonomy:Deltaproteobacteria bacterium RIFOXYA12_FULL_61_11
  REGION 1..151: note = MG1-290 HNH domain
SLGLGKKANDDLKKKQATQREEREAARQEAAEHHAAGSQAVLRFRLAKEVGKVCPYCHQPFHADLADAEIEHILPRALGGSDQQVNLTVAHTHCNHEKHDQLPHAAWGEADRWPCLERFAREHFKGLKLQLFLHQGNPEEALALLAPPADL

SEQ ID NO: 3920 - protein, 149 aa, unidentified
  REGION 1..149: note = Description of Unknown:uncultivated organism with predicted taxonomy: CandidatusTermititenax aidoneus
  REGION 1..149: note = MG1-291 HNH domain
EDFMGDKKRREYIKIMNQRRKAKDEAFNEIKDLVKGKQSLIKQLLLKEQGCKDIYSYETLIPSQLNDYEIDHIVPRSKGGSDAMYNKVLTKASNNQEKGNRIPFEWLSADKEKWNMFYKNVESFRLNWKKKELLLAKDPTLLIEKYTTL

SEQ ID NO: 3921 - protein, 155 aa, unidentified
  REGION 1..155: note = Description of Unknown:uncultivated organism with predicted taxonomy: CandidatusTermititenax aidoneus
  REGION 1..155: note = MG1-292 HNH domain
DEFMGKQAKEDYYKFIKEQTKERKIVVEELEKAGFSKPSGEMIRKMMLFRQQDGIDFYSMQNIKLSHLGEYEIDHVIPRSRGGSDAFYNIILTTNKNNSAKGDKTPYEWLGKGDIWDNISEKLKVNKKMGSKKKLLFMASSEEQYKLLIDKYTQL

SEQ ID NO: 3922 - protein, 155 aa, unidentified; identical to SEQ ID NO: 3921
  REGION 1..155: note = Description of Unknown:uncultivated organism with predicted taxonomy: Elusimicrobiabacterium HGW-Elusimicrobia-1
  REGION 1..155: note = MG1-293 HNH domain

SEQ ID NO: 3923 - protein, 157 aa, unidentified
  REGION 1..157: note = Description of Unknown:uncultivated organism with predicted taxonomy: Endomicrobiumproavitum
  REGION 1..157: note = MG1-294 HNH domain
EDFAGEEKRKEYIDTQNKNTKNIELAVKLLKEANKQLNNRNILKARLLIEQNNVDLYEIDEHRKISITNIDDYEIDHIIPRSRGGSDSFSNFVITSINNNQTKLNRTPYEWFHQDKSFDAWNTYIKNIEGIKGLSKHKIKLLISDKAIELENKKTDL

SEQ ID NO: 3924 - protein, 149 aa, unidentified
  REGION 1..149: note = Description of Unknown:uncultivated organism with predicted taxonomy: Verrucomicrobiabacterium 12-59-8
  REGION 1..149: note = MG1-295 HNH domain
EDFMGEEAKKKLQKFQNENRKAWDQARSQARELNLSGGGNVRKLRMLREQNFICPYTGDTLSENEVDTLEVEHIVPRARGGSDNQYNKVVTRTRTNREKGDHTPYEWLTQKEEFAAFCERVEKMGLSRKKKEILTAKDPFTLDQKWDSL

SEQ ID NO: 3925 - protein, 166 aa, unidentified
  REGION 1..166: note = Description of Unknown:uncultivated organism
  REGION 1..166: note = MG1-296 HNH domain
EEFLGEDKRAQYIKTQNENRKDKDLAKEELMTVIKSADPSYQTKLLKVRLLREQHYKDVYDLTENCALSIQDIDDYDIDHIVPISCGGADSMVNKVLTKKELNETKKQNQTPYEMYFQNASAETWAKYLEHLKDVYGKNISKHLEKKYELLTSDKAIEIESKRNDL

SEQ ID NO: 3926 - protein, 149 aa, unidentified
  REGION 1..149: note = Description of Unknown:uncultivated organism with predicted taxonomy: Verrucomicrobiabacterium 12-59-8
  REGION 1..149: note = MG1-297 HNH domain
EDFMGEEAKEKPKKFQNENRKAWDQARSQARELNLSGGGNVRKLRMLREQNFICPYTGDTLSENEVDTLEVEHIVPRARGGSDNQYNKVVTRSQTNREKGDHTPYEWLTQKGEFAAFCERVEKMGLSRKKKEILTAKDPFTLDQKWDSL

SEQ ID NO: 3927 - protein, 158 aa, unidentified
  REGION 1..158: note = Description of Unknown:uncultivated organism
  REGION 1..158: note = MG1-298 HNH domain
DEFLSEEEKADLNRANKERQKNNKKAYEELKKYGLEISHDNMEKYKLCESQKWTDIYNVFDDKKKISPEDLPNYDIDHIVPVSSGGADSLANKVVTARHLNQSQKSNKTPYQWLFEDKIKWADFLENIKNAGIDKNSKKYLFLTAKDAVSQAKSLNDL

SEQ ID NO: 3928 - protein, 154 aa, unidentified
  REGION 1..154: note = Description of Unknown:uncultivated organism
  REGION 1..154: note = MG1-299 HNH domain
EDFMGDKARMELKKFQNDRAKARAEARERVAELGISEKNSLRYELWKAQGGRCLYTDDPLAETELDNYHVDHIVPRAKGGPDSRLNYVLTLNQTNDDKDDRTPFEWLSCNPARWLAYVNRVESRLKAADGISRKTAQLLTLPNAVELAEKYTAL

SEQ ID NO: 3929 - protein, 154 aa, unidentified
  REGION 1..154: note = Description of Unknown:uncultivated organism
  REGION 1..154: note = MG1-300 HNH domain
EDFMGEEAKKRYLKFMNDRAKSRAEAREKVAALGISDKNILRYELWKSQGCRCLYTDLPLEETKLDDYKVDHIVPRAQGGPDSRLNYALTHNATNDEKDDRTPYEWLSGDSVKWQAYLNRVNARLKAADGISRKTAQLLTLPNAAELAEKYTAL

SEQ ID NO: 3930 - protein, 154 aa, unidentified
  REGION 1..154: note = Description of Unknown:uncultivated organism
  REGION 1..154: note = MG1-301 HNH domain
EDFMGEKARMELRNFQNRRAKARAEARERVAELGISEKNSLRYELFKAQGGRCLYTDDPLAETELDNYRVDHIVPRAKGGPDSRLNYALTLNQTNDDKGDRTPYEWLSGNPVRWQAYLNRVEARLKTTDGISRKTAQLLTLPNAVELAEKYTAL

SEQ ID NO: 3931 - protein, 154 aa, unidentified
  REGION 1..154: note = Description of Unknown:uncultivated organism
  REGION 1..154: note = MG1-302 HNH domain
EDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTAL

SEQ ID NO: 3932 - protein, 154 aa, unidentified; identical to SEQ ID NO: 3931
  REGION 1..154: note = Description of Unknown:uncultivated organism
  REGION 1..154: note = MG1-303 HNH domain

SEQ ID NO: 3933 - protein, 160 aa, unidentified
  REGION 1..160: note = Description of Unknown:uncultivated organism with predicted taxonomy: Verrucomicrobia
  REGION 1..160: note = MG1-304 HNH domain
NDKDNSLEGQKRTQVYQDILKRNEDRRETARKALRASSLPDSDEMVVRWLLYQEQGPFCIYSGQPIRCSELPNLQIEHIVPRALGGPDAYWNWVLCKTDQNVEKGNRVPYQWFHEEKKSGEWEDYRRRVRNRATWLGSRKVDLLLRADAKELVGEKYTAL

SEQ ID NO: 3934 - protein, 154 aa, unidentified
  REGION 1..154: note = Description of Unknown:uncultivated organism with predicted taxonomy: Verrucomicrobiabacterium IMCC26134
  REGION 1..154: note = MG1-305 HNH domain
EDFMGDKARMELKKFQNDRAKARAEARERVAELGISEKNSLRYELWKAQGGRCLYMDDPLAETELDNYRIDHIVPRAKCGPDSRLNYALTLNQTNDDKGDRTPYEWLSGNPERWRAYLNRVEARLRAADGISRKTAQLLTLPNAVELAEKFTAL

SEQ ID NO: 3935 - protein, 151 aa, unidentified
  REGION 1..151: note = Description of Unknown:uncultivated organism with predicted taxonomy: Verrucomicrobia
  REGION 1..151: note = MG1-306 HNH domain
EDFMGKKAKIEYFKFQRDRAAQRAKAREEAAKAGAGEGAAGLKMELLEAQGGACLYTGEALAPTSLDDYVIDHIVPRAKGGPDSALNYVLTTRRANDDKADRTPHEWLSATNGWDAYVERVKKRTTALRNKKASLLVSPEAETLVQRYTAL

SEQ ID NO: 3936 - protein, 185 aa, unidentified; identical to SEQ ID NO: 3904
  REGION 1..185: note = Description of Unknown:uncultivated organism with predicted taxonomy: Verrucomicrobiabacterium IMCC26134
  REGION 1..185: note = MG1-307 HNH domain

SEQ ID NO: 3937 - protein, 172 aa, unidentified
  REGION 1..172: note = Description of Unknown:uncultivated organism
  REGION 1..172: note = MG1-308 HNH domain
DPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTA

SEQ ID NO: 3938 - protein, 154 aa, unidentified
  REGION 1..154: note = Description of Unknown:uncultivated organism
  REGION 1..154: note = MG1-309 HNH domain
DMPRNQDQSREIQKEQKERREERRHIAAIYGLDFDVLTEPQKRRLFLFHEQAGRDGEAVCPYTGESLGRDPLAADLEIEHIYPQRRGGLSIMENLAITRRATNAEKGNRTPVEWLGYEKAAEQASRMRWSKRKLEVFLWREERCPDWENLTRTA

SEQ ID NO: 3939 - protein, 167 aa, unidentified
  REGION 1..167: note = Description of Unknown:uncultivated organism
  REGION 1..167: note = MG1-310 HNH domain
DPPRNAQQRAERQKEIEANREKHEKLFEQYGIEDSGVASKRRRIMLYEQQRGKCPYTGKDLPSNPLDPSLEIEHIFPAEMGGLSVDDNLVLTWRSVNAEKGKRTPLQWAGERFDAMLANTRDMRWSARKREIFAWGTIREDKPDKPSHYNADGTLRVPDFGNTTRTA

SEQ ID NO: 3940 - protein, 171 aa, unidentified
  REGION 1..171: note = Description of Unknown:uncultivated organism
  REGION 1..171: note = MG1-311 HNH domain
DAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTA

SEQ ID NO: 3941 - protein, 171 aa, unidentified; identical to SEQ ID NO: 3940
  REGION 1..171: note = Description of Unknown:uncultivated organism
  REGION 1..171: note = MG1-312 HNH domain

SEQ ID NO: 3942 - protein, 172 aa, unidentified; identical to SEQ ID NO: 3937
  REGION 1..172: note = Description of Unknown:uncultivated organism
  REGION 1..172: note = MG1-314 HNH domain

SEQ ID NO: 3943 - protein, 171 aa, unidentified
  REGION 1..171: note = Description of Unknown:uncultivated organism with predicted taxonomy: Verrucomicrobiabacterium
  REGION 1..171: note = MG1-315 HNH domain
DAPRTTKQAQEIKFAQDERGQKRRELFAARNLEDSGVASKRRRISLWDQQKGVCPYTGNELPKDPLDPSLELEHIFPAEMGGLSTDENLVLTSRTVNSDKGKHTPLQFANKLRVPFDQLVAHTQDMRWSAKKREIFAWGTLREDKDDQKSHYLPDGVSLRVPDFGNTTRTA

SEQ ID NO: 3944 - protein, 185 aa, unidentified; identical to SEQ ID NO: 3904
  REGION 1..185: note = Description of Unknown:uncultivated organism with predicted taxonomy: Thiorhodospirasibirica
  REGION 1..185: note = MG1-316 HNH domain

SEQ ID NO: 3945 - protein, 170 aa, unidentified
  REGION 1..170: note = Description of Unknown:uncultivated organism
  REGION 1..170: note = MG1-317 HNH domain
DPPRNALQRAERDQEMKERREKRNKLFEQHHLDDSGVASRRRRVTLWEQQKGKCPFTGKELPANPLDPSLELEHIFPEDMGGLSVEENLALTWRTVNADKGKRTPLQFAAKLGVPFDQLMAHTQEMRWSAKKREIFAWGAIKEDRGDQASHYNPDGALRIPDFGNITRMA

SEQ ID NO: 3946 - protein, 171 aa, unidentified; identical to SEQ ID NO: 3940
  REGION 1..171: note = Description of Unknown:uncultivated organism
  REGION 1..171: note = MG1-318 HNH domain

SEQ ID NO: 3947 - protein, 153 aa, unidentified
  REGION 1..153: note = Description of Unknown:uncultivated organism with predicted taxonomy: Verrucomicrobiabacterium IMCC26134
  REGION 1..153: note = AKC83434.1 HNH domain
TDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTAL

SEQ ID NO: 3948 - protein, 153 aa, unidentified; identical to SEQ ID NO: 3947
  REGION 1..153: note = Description of Unknown:uncultivated organism with predicted taxonomy: Verrucomicrobiabacterium IMCC26134
  REGION 1..153: note = AKC83434.1 HNH domain

SEQ ID NO: 3949 - protein, 151 aa, unidentified
  REGION 1..151: note = Description of Unknown:uncultivated organism with predicted taxonomy: Verrucomicrobiabacterium 61-8
  REGION 1..151: note = OJV06180.1 HNH domain
EDFMGKKAVIEYRAFLKKREAERKRAREDAAKTGSTERSAALKLELLREQGGICLYTGSALKETALEQYEIDHIVPRSKGGPDAVINYVLTLRSANDEKGDRTPFEWLSRTNQWDAYVQRVDSRGTVLRNKKTKLLLNENASELAERYTAL

SEQ ID NO: 3950 - protein, 151 aa, unidentified; identical to SEQ ID NO: 3949
  REGION 1..151: note = Description of Unknown:uncultivated organism with predicted taxonomy: Verrucomicrobiabacterium 61-8
  REGION 1..151: note = OJV06180.1 HNH domain

SEQ ID NO: 3951 - protein, 168 aa, unidentified
  REGION 1..168: note = Description of Unknown:uncultivated organism with predicted taxonomy: Pedosphaera sp.Tous-C6FEB
  REGION 1..168: note = PAW75411.1 HNH domain
EDFMGEKALAELQDFQRRREADRKEAKEMAAAAGATSSLSALKYQLWKAQGGECLYGKEVFNESGVSKAQCLYRGTALPFTKLDDYVIDHIVPRAKGGPDAMVNYVLTTHETNEAKGDRTPFEWLRSAPDWDAYNKRVAARAHTLRNKKVQLLTREDAPELVQRYTAL

SEQ ID NO: 3952 - protein, 168 aa, unidentified; identical to SEQ ID NO: 3951
  REGION 1..168: note = Description of Unknown:uncultivated organism with predicted taxonomy: Pedosphaera sp.Tous-C6FEB
  REGION 1..168: note = PAW75411.1 HNH domain

SEQ ID NO: 3953 - protein, 153 aa, unidentified; identical to SEQ ID NO: 3947
  REGION 1..153: note = Description of Unknown:uncultivated organism with predicted taxonomy: Verrucomicrobiabacterium IMCC26134
  REGION 1..153: note = WP_082083265.1 HNH domain

SEQ ID NO: 3954 - protein, 153 aa, unidentified; identical to SEQ ID NO: 3947
  REGION 1..153: note = Description of Unknown:uncultivated organism with predicted taxonomy: Verrucomicrobiabacterium IMCC26134
  REGION 1..153: note = WP_082083265.1 HNH domain

SEQ ID NO: 3955 - protein, 157 aa, unidentified; identical to SEQ ID NO: 3711
  REGION 1..157: note = Description of Unknown:uncultivated organism
  REGION 1..157: note = MG2-1 HNH domain

SEQ ID NO: 3956 - protein, 185 aa, unidentified
  REGION 1..185: note = Description of Unknown:uncultivated organism
  REGION 1..185: note = MG2-7 HNH domain
ELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDL

SEQ ID NO: 3957 - protein, 210 aa, unidentified
  REGION 1..210: note = Description of Unknown:uncultivated organism
  REGION 1..210: note = MG2-3 HNH domain
DILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDL

SEQ ID NO: 3958 - protein, 195 aa, unidentified
  REGION 1..195: note = Description of Unknown:uncultivated organism with predicted taxonomy: Verrucomicrobia
  REGION 1..195: note = MG2-5 HNH domain
DLREMSGKSNYDKQADLNNRVKNHHSVVEYLHEHLPAKYHNRINGSLIRKARVAADLDWKCPYTNEAIQPIHLITKVVDLDHVVPHALRPSDGLDSLVVTFCAVNKMKGKRTAWQFIKDEETRSVSYRNEQGKEEKVDGMPNLKIRFFSDYKKFVDDLKIKAKGEHKADAERRERRQQLLRLANYEEKAFLPRDL

SEQ ID NO: 3959 - protein, 179 aa, unidentified
  REGION 1..179: note = Description of Unknown:uncultivated organism with predicted taxonomy: Verrucomicrobiabacterium
  REGION 1..179: note = MG2-6 HNH domain
DLREFSGMTAKEIASELTKITSDHRKAVQYLEENLKGKPYKITASLIRKTRIAMDLDWTCPYTGQKYDIYDLLEKRVDLDHIIPQSIRPSNSLESLVITFPEVNRFKAQRLAFQFVKEEQTKTVKGLPNLQIRTLENYKNWGENLKESRFDRNKSPQSKRKKLLLLPEYVQEEFLPRDL

SEQ ID NO: 3960 - protein, 187 aa, unidentified
  REGION 1..187: note = Description of Unknown:uncultivated organism with predicted taxonomy: Verrucomicrobia
  REGION 1..187: note = MG2-8 HNH domain
DLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDL

SEQ ID NO: 3961 - protein, 187 aa, unidentified; identical to SEQ ID NO: 3960
  REGION 1..187: note = Description of Unknown:uncultivated organism with predicted taxonomy: Verrucomicrobia
  REGION 1..187: note = MG2-10 HNH domain

SEQ ID NO: 3962 - protein, 193 aa, unidentified
  REGION 1..193: note = Description of Unknown:uncultivated organism
  REGION 1..193: note = MG2-11 HNH domain
DLREISGKTAKEKAQELGQRLANFKSVTKKLEEAFEGRNVHISPGLIRKARVAEDLGWTCPYTGQRYDPLDLLNAKVDKDHVIPRTERASDSLDSLVITFPAVNKWKDKRTALKFIEDEQGQPVLDMPNLSIKTFAQYEADVKALRPSFDPRPAKRDGRTKGPIDDDLRRWNRKQLLLNVRKWEEKEFLPRDL

SEQ ID NO: 3963 - protein, 187 aa, unidentified
  REGION 1..187: note = Description of Unknown:uncultivated organism with predicted taxonomy: Verrucomicrobiabacterium
  REGION 1..187: note = MG2-12 HNH domain
DVQTTSGMTNKEKAKELGSKIKHHHETAAWLAERLEDERDENGRRFVIGPSLIRKARIADDLGWECPYTGRKFEPADLIHRRYDKDHIVPRSKRLSDALEAMVITSCEVNREKKNRTALQFIKDMNLPENRAVRERLNIRTEAQFREFVDELKAKGSHADDVRRRKRRKELLLVQKYEEKEFTPADL

SEQ ID NO: 3964 - protein, 180 aa, unidentified
  REGION 1..180: note = Description of Unknown:uncultivated organism with predicted taxonomy: Verrucomicrobiabacterium
  REGION 1..180: note = MG2-13 HNH domain
DLREMSGKTAKEKAQDLGQRLANFKNVAEKLEEAFEGKDVHISPGLIRKARIAEDLGWTCPYTHHSYDAFQLLNRTVDKDHIIPRTERASDSLDSLVITFSAINKWKGKRTAMKFVEDEQGNPVPDMPNLSIVTLTHYKAFVEGLDTFRGHDDDKRRKKNRQRLLLVRDYEKPEFTPRDL

SEQ ID NO: 3965 - protein, 190 aa, unidentified
  REGION 1..190: note = Description of Unknown:uncultivated organism with predicted taxonomy: Verrucomicrobiabacterium
  REGION 1..190: note = MG2-14 HNH domain
DLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDTRGESHTFSPKEFREFVGGLKNKNGPAKDDEVRCKKRKIALLTPIYERRGKVKQTDTGEEVLEAFTDGTL

SEQ ID NO: 3966 - protein, 190 aa, unidentified
  REGION 1..190: note = Description of Unknown:uncultivated organism with predicted taxonomy: Verrucomicrobiabacterium
  REGION 1..190: note = MG2-15 HNH domain
DLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDPRGESHTFSPKEFREFVGRLKNKNGPAKDDEVRCKKRKIALLTPIYERRGKVKQTDTGEEVLEAFTDGTL

SEQ ID NO: 3967 - protein, 197 aa, unidentified
  REGION 1..197: note = Description of Unknown:uncultivated organism with predicted taxonomy: Verrucomicrobiabacterium
  REGION 1..197: note = MG2-16 HNH domain
DLREMSGKTAKEKAQYFRLLTADHHRVAEKLKKALAGQTVDGKPIRISASRIRKARVAEDLNWTCPYTGQKYEPIDLVTERVDEDHIVPRSQRMSDSLESLVISFSAVNKWKGKRTAMRFIKEEQGKPVPGLPNLSIVSLNRYLEFVDSLPPRNDPRKLKRHLKLLQPIDDDLRKWRRKELLKLEEYEQEEFTPRDL

SEQ ID NO: 3968 - protein, 210 aa, unidentified; identical to SEQ ID NO: 3957
  REGION 1..210: note = Description of Unknown:uncultivated organism
  REGION 1..210: note = MG2-17 HNH domain

SEQ ID NO: 3969 - protein, 185 aa, unidentified
  REGION 1..185: note = Description of Unknown:uncultivated organism with predicted taxonomy: Verrucomicrobia
  REGION 1..185: note = MG2-18 HNH domain
DLREFSGKTAKEKAQDLGLRIADHHRVAEKLQKALAGQTLNGQPIRIGPALIRKARIAEDLGWTCPYTGQKYEPIDLVTRRVDKDHIVPRSQRASDSLDSMVITFSAINKWKGKRTALKFVEDEQGKPVPDLPNLSIVSLSRYRDFVEKLDTFKGHDQDKKRKKRRKALLLVRDYEEEEFTPRDL

SEQ ID NO: 3970 - protein, 182 aa, unidentified
  REGION 1..182: note = Description of Unknown:uncultivated organism with predicted taxonomy: Verrucomicrobia
  REGION 1..182: note = MG2-19 HNH domain
DLREFSGMTAKEIESELNARSADFKKAKKQLEDMLLKAGLSNTRITATLIKKARIAQDLDFTCPYTGAKYELIDLINKQVDLEHIIPKSKRPSDSMESLVITFKEVNRWKGNRTALRFIKEEQNKPVQGKGNLMILTEKRYQELVNGLNTKGHPKDTERKKKRKELLLMEDYVEEEFLPRDL

SEQ ID NO: 3971 - protein, 180 aa, unidentified
  REGION 1..180: note = Description of Unknown:uncultivated organism with predicted taxonomy: Verrucomicrobiabacterium
  REGION 1..180: note = MG2-20 HNH domain
ELRDLSGKTRKEQEQDLGLRLGDFKRVAAKVEEACRRRGIPCTAGLIRKARVAEDLGWKCPYTGKEFSVDTLLDGVMDKDHIIPHADRQSDSLDSLVITWNEVNKWKGKRTALEFIREEGGKPVPGRPELTVMTLAEFQKHVASLDIRKGHDDDRARKKRRIRRLLTEYYEEKEFTPRDL

SEQ ID NO: 3972 - protein, 182 aa, unidentified
  REGION 1..182: note = Description of Unknown:uncultivated organism
  REGION 1..182: note = MG2-21 HNH domain
DLREFSGMTAKEIESELNARSADFKKAKKQLENMLQEAGLSNTRITATLIKKARIAQDLDFTCPYTGAKYELIDLINKQVDLEHIIPKSKRPSDSMESLVITFKEVNRWKGNRTALRFIKEEQNKPVPGKENLMILTEKRYQELVNGLNTKGHPKDTERKKKRKELLLMEDYVEEKFLPRDL

SEQ ID NO: 3973 - protein, 210 aa, unidentified; identical to SEQ ID NO: 3957
  REGION 1..210: note = Description of Unknown:uncultivated organism
  REGION 1..210: note = MG2-22 HNH domain

SEQ ID NO: 3974 - protein, 185 aa, unidentified
  REGION 1..185: note = Description of Unknown:uncultivated organism with predicted taxonomy: Verrucomicrobiabacterium
  REGION 1..185: note = MG2-23 HNH domain
DLREFSGKTAKEKTQDLGLRVADHHRVAEKLQKALAGQTVNGQPIRIGPGLIRKARIAEDLGWTCPYTGQKYEPIDLVTRRVDKDHIVPRSQRMSDSLDSLVITFSAINKWKGNRTALKFVEDEQGKPVPDLPNLSIVSLSRYREFVEKLETFKGHDDDKKRKKRRKALLLLRDYEEEEFTPRDL

SEQ ID NO: 3975 - protein, 180 aa, unidentified
  REGION 1..180: note = Description of Unknown:uncultivated organism with predicted taxonomy: Verrucomicrobiabacterium
  REGION 1..180: note = MG2-24 HNH domain
DLRDLSGKTRKEQEQDLGLRLGDFKRVAAKVEEACKRRNLRVTAGIIRKARVAEDLGWRCPYTGKEFCIDTLLDGVMDKEHIIPHADRQSDSLDSLVITWNEVNKWKGKRTAMEFIREEGGKPVPGRPELEIMSLAAFQKHVASLDTRKGHDDDRARKKRRIRRLLTEHYEEKEFTPRDL

SEQ ID NO: 3976 - protein, 185 aa, unidentified
  REGION 1..185: note = Description of Unknown:uncultivated organism
  REGION 1..185: note = MG2-25 HNH domain
DLREFSGMTRKAIEMDLGSRLKNFKSVSDKLEKAFDSQTYNGKPVQVTAGLIRKARIAEDLGWQCPYTGQSFEPVHLVSRAVDKDHVIPRSQRPSDSLESLVVTFSEVNKMKGQRTAWQFIQEFGGKPVEGMPNLMIRTPKQFEEFVTKLESFKGHEDDKRRKKRRKDLLLLPKFEDKGFVPRDL

SEQ ID NO: 3977 - protein, 180 aa, unidentified
  REGION 1..180: note = Description of Unknown:uncultivated organism with predicted taxonomy: Verrucomicrobiabacterium
  REGION 1..180: note = MG2-26 HNH domain
DLRELSGKTRKEQEQDLGQRLANFKSVVRKLEESFDGKKVKITPGLIRKARVAEDLGWTCPYTGKAYDAFDLLNRAVDKDHIIPRSQRASDSLDSLVITFAEVNKMKGKRTALRFIEEFQGQPVPGAPRLSLRTLRDYQQWVEGLETFKGHPDDQRRKKQRKKLLLLPEYVEKDFVPRDL

SEQ ID NO: 3978 - protein, 181 aa, unidentified
  REGION 1..181: note = Description of Unknown:uncultivated organism
  REGION 1..181: note = MG2-27 HNH domain
DLRSFSGMTAEEKKQEMGQRLGDFKKVVQKLRGDLPEVTAISAGLIRKARIAQDMNWTCPYTGMEYDALDLLHGHVDKDHIIPRSLRPSDSLDSLVLTLRTINEMKGQRTAVQFIKEFEGREVQDGKKRSLEILPWSQFQKLVESLDAKGIHDQDRARKKRRKALLLQEHYTEKEFVPKDL

SEQ ID NO: 3979 - protein, 180 aa, unidentified
  REGION 1..180: note = Description of Unknown:uncultivated organism with predicted taxonomy: Verrucomicrobia
  REGION 1..180: note = MG2-28 HNH domain
DLREMAGRTSQEIAKELGARVANHKKVANRLFGELPEGTRITGSLIRKARIADDLGWRCPYTGVEFEPVDLVEGRVDRDHIIPRSQRMSDSLDSLVITFSAVNKWKGQRTAWQFIQEEGGKPVPDAPNLSIVTPARFRDFVEHLDTKGHRDDYRRKKRRKELLLLERYEERTSGFTPGQL

SEQ ID NO: 3980 - protein, 182 aa, unidentified
  REGION 1..182: note = Description of Unknown:uncultivated organism with predicted taxonomy: Verrucomicrobiabacterium
  REGION 1..182: note = MG2-29 HNH domain
EVSSMSGKTMKLIKMEEGLKRSDHKKASKIMEAAVEESGENIRVGAGLIRKARVAQDLDWTCPYTGEKFDPLALIHSQVDLDHIIPRSERLSDAMAGLVVTFSEINRWKGARTAYQFISEEQGKQVPGKPNLSIMSLKAYEDFVGKLKISGGHDSDVGRRKARKGYLLLASYQDKEFTPRDL

SEQ ID NO: 3981 - protein, 182 aa, unidentified
  REGION 1..182: note = Description of Unknown:uncultivated organism with predicted taxonomy: Verrucomicrobiabacterium
  REGION 1..182: note = MG2-30 HNH domain
EISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDL

SEQ ID NO: 3982 - protein, 182 aa, unidentified; identical to SEQ ID NO: 3981
  REGION 1..182: note = Description of Unknown:uncultivated organism with predicted taxonomy: Verrucomicrobiabacterium
  REGION 1..182: note = MG2-31 HNH domain

SEQ ID NO: 3983 - protein, 182 aa, unidentified; identical to SEQ ID NO: 3981
  REGION 1..182: note = Description of Unknown:uncultivated organism with predicted taxonomy: Verrucomicrobiabacterium
  REGION 1..182: note = MG2-32 HNH domain

SEQ ID NO: 3984 - protein, 182 aa, unidentified; identical to SEQ ID NO: 3981
  REGION 1..182: note = Description of Unknown:uncultivated organism with predicted taxonomy: Verrucomicrobiabacterium
  REGION 1..182: note = MG2-33 HNH domain

SEQ ID NO: 3985 - protein, 182 aa, unidentified; identical to SEQ ID NO: 3981
  REGION 1..182: note = Description of Unknown:uncultivated organism with predicted taxonomy: Verrucomicrobiabacterium
  REGION 1..182: note = MG2-34 HNH domain

SEQ ID NO: 3986 - protein, 188 aa, unidentified
  REGION 1..188: note = Description of Unknown:uncultivated organism with predicted taxonomy: Thermoguttaterrifontis
  REGION 1..188: note = MG2-35 HNH domain
DLVEFSGKSAKEKARILGQQLWHHRKISKFLEEEKAKNEGNWEISAGLIKKARIADDLNWICPYTGKQYSLNQIIHGDVDLEHIIPRSKRPTDALHALVLTFSHINREKGARTGLQYIEDTKDSPHTLTPEQYRKFVGRLKKNGPSKDDELRCTKRKIALLTQDYEPRGKAKEKSDSESVSGFTEGSL

SEQ ID NO: 3987 - protein, 183 aa, unidentified
  REGION 1..183: note = Description of Unknown:uncultivated organism with predicted taxonomy:Coraliomargarita sp. CAG:312
  REGION 1..183: note = MG2-36 HNH domain
DITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDL

SEQ ID NO: 3988 - protein, 183 aa, unidentified
  REGION 1..183: note = Description of Unknown:uncultivated organism with predicted taxonomy:Coraliomargarita sp. CAG:312
  REGION 1..183: note = MG2-37 HNH domain
DMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADL

SEQ ID NO: 3989 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-38 HNH domain

SEQ ID NO: 3990 - protein, 183 aa, unidentified; identical to SEQ ID NO: 3988
  REGION 1..183: note = Description of Unknown:uncultivated organism with predicted taxonomy: Verrucomicrobiabacterium
  REGION 1..183: note = MG2-39 HNH domain

SEQ ID NO: 3991 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-40 HNH domain

SEQ ID NO: 3992 - protein, 183 aa, unidentified; identical to SEQ ID NO: 3988
  REGION 1..183: note = Description of Unknown:uncultivated organism with predicted taxonomy:Coraliomargarita sp. CAG:312
  REGION 1..183: note = MG2-41 HNH domain

SEQ ID NO: 3993 - protein, 183 aa, unidentified; identical to SEQ ID NO: 3988
  REGION 1..183: note = Description of Unknown:uncultivated organism with predicted taxonomy:Coraliomargarita sp. CAG:312
  REGION 1..183: note = MG2-42 HNH domain

SEQ ID NO: 3994 - protein, 183 aa, unidentified; identical to SEQ ID NO: 3988
  REGION 1..183: note = Description of Unknown:uncultivated organism with predicted taxonomy: Verrucomicrobia
  REGION 1..183: note = MG2-43 HNH domain

SEQ ID NO: 3995 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-44 HNH domain

SEQ ID NO: 3996 - protein, 183 aa, unidentified; identical to SEQ ID NO: 3988
  REGION 1..183: note = Description of Unknown:uncultivated organism with predicted taxonomy:Coraliomargarita sp. CAG:312
  REGION 1..183: note = MG2-45 HNH domain

SEQ ID NO: 3997 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-46 HNH domain

SEQ ID NO: 3998 - protein, 183 aa, unidentified; identical to SEQ ID NO: 3988
  REGION 1..183: note = Description of Unknown:uncultivated organism with predicted taxonomy: Verrucomicrobiabacterium
  REGION 1..183: note = MG2-47 HNH domain

SEQ ID NO: 3999 - protein, 183 aa, unidentified
  REGION 1..183: note = Description of Unknown:uncultivated organism with predicted taxonomy:Coraliomargarita sp. CAG:312
  REGION 1..183: note = MG2-48 HNH domain
DITAFSGLDSKKKAAKLNDLVAHHKSVSAYLKKEYPEISPNGSILRKARIADDLGWVCPYTGCHFSPRQLFESGNMEREHIIPRSLRPSDSLESLVITWKEVNDMKGQCTAYEFIKECQGMKVPGRQNLSIVTPERFEAFVRRLKKPMHPAGKADIERIKIRNKLLLTEHYKKREGGFLPSDL

SEQ ID NO: 4000 - protein, 183 aa, unidentified; identical to SEQ ID NO: 3988
  REGION 1..183: note = Description of Unknown:uncultivated organism with predicted taxonomy:Coraliomargarita sp. CAG:312
  REGION 1..183: note = MG2-49 HNH domain

SEQ ID NO: 4001 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-50 HNH domain

SEQ ID NO: 4002 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-51 HNH domain

SEQ ID NO: 4003 - protein, 183 aa, unidentified; identical to SEQ ID NO: 3988
  REGION 1..183: note = Description of Unknown:uncultivated organism with predicted taxonomy: Verrucomicrobiabacterium
  REGION 1..183: note = MG2-52 HNH domain

SEQ ID NO: 4004 - protein, 183 aa, unidentified; identical to SEQ ID NO: 3988
  REGION 1..183: note = Description of Unknown:uncultivated organism with predicted taxonomy: Verrucomicrobiabacterium
  REGION 1..183: note = MG2-53 HNH domain

SEQ ID NO: 4005 - protein, 183 aa, unidentified
  REGION 1..183: note = Description of Unknown:uncultivated organism with predicted taxonomy:Coraliomargarita sp. CAG:312
  REGION 1..183: note = MG2-54 HNH domain
DMTAFSGLDSKKKAAKLKDLVAHHESVSKYLKNEYPNLKTNGSILRKARIADDLGWVCPYTGCHFSPRQLFESGNMEKEHIIPRSLRPSDSLESLVVTWKEVNDMKGQRTALEFIKECQGMKVPGRPNLSIVTPARFEEFVSGLRKPMHRAGKADIERIKIRNKLLLTEHYKNREGEFLPSDL

SEQ ID NO: 4006 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-55 HNH domain

SEQ ID NO: 4007 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-56 HNH domain

SEQ ID NO: 4008 - protein, 183 aa, unidentified; identical to SEQ ID NO: 3988
  REGION 1..183: note = Description of Unknown:uncultivated organism with predicted taxonomy:Coraliomargarita sp. CAG:312
  REGION 1..183: note = MG2-57 HNH domain

SEQ ID NO: 4009 - protein, 183 aa, unidentified; identical to SEQ ID NO: 3988
  REGION 1..183: note = Description of Unknown:uncultivated organism with predicted taxonomy: Verrucomicrobiabacterium
  REGION 1..183: note = MG2-58 HNH domain

SEQ ID NO: 4010 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-59 HNH domain

SEQ ID NO: 4011 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-60 HNH domain

SEQ ID NO: 4012 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-61 HNH domain

SEQ ID NO: 4013 - protein, 185 aa, unidentified
  REGION 1..185: note = Description of Unknown:uncultivated organism with predicted taxonomy: Verrucomicrobia
  REGION 1..185: note = MG2-62 HNH domain
ELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDL

SEQ ID NO: 4014 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-63 HNH domain

SEQ ID NO: 4015 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-64 HNH domain

SEQ ID NO: 4016 - protein, 183 aa, unidentified; identical to SEQ ID NO: 3988
  REGION 1..183: note = Description of Unknown:uncultivated organism with predicted taxonomy:Coraliomargarita sp. CAG:312
  REGION 1..183: note = MG2-65 HNH domain

SEQ ID NO: 4017 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-66 HNH domain

SEQ ID NO: 4018 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-67 HNH domain

SEQ ID NO: 4019 - protein, 183 aa, unidentified; identical to SEQ ID NO: 3999
  REGION 1..183: note = Description of Unknown:uncultivated organism with predicted taxonomy:Coraliomargarita sp. CAG:312
  REGION 1..183: note = MG2-68 HNH domain

SEQ ID NO: 4020 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-69 HNH domain

SEQ ID NO: 4021 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-70 HNH domain

SEQ ID NO: 4022 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-71 HNH domain

SEQ ID NO: 4023 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-72 HNH domain

SEQ ID NO: 4024 - protein, 183 aa, unidentified; identical to SEQ ID NO: 3988
  REGION 1..183: note = Description of Unknown:uncultivated organism with predicted taxonomy: Verrucomicrobiabacterium
  REGION 1..183: note = MG2-73 HNH domain

SEQ ID NO: 4025 - protein, 185 aa, unidentified; identical to SEQ ID NO: 4013
  REGION 1..185: note = Description of Unknown:uncultivated organism with predicted taxonomy: Verrucomicrobia
  REGION 1..185: note = MG2-74 HNH domain

SEQ ID NO: 4026 - protein, 183 aa, unidentified; identical to SEQ ID NO: 3987
  REGION 1..183: note = Description of Unknown:uncultivated organism with predicted taxonomy:Coraliomargarita sp. CAG:312
  REGION 1..183: note = MG2-75 HNH domain

SEQ ID NO: 4027 - protein, 193 aa, unidentified
  REGION 1..193: note = Description of Unknown:uncultivated organism with predicted taxonomy: Verrucomicrobiabacterium
  REGION 1..193: note = MG2-76 HNH domain
DLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADL

SEQ ID NO: 4028 - protein, 193 aa, unidentified; identical to SEQ ID NO: 4027
  REGION 1..193: note = Description of Unknown:uncultivated organism
  REGION 1..193: note = MG2-77 HNH domain

SEQ ID NO: 4029 - protein, 193 aa, unidentified; identical to SEQ ID NO: 4027
  REGION 1..193: note = Description of Unknown:uncultivated organism with predicted taxonomy: Verrucomicrobiabacterium
  REGION 1..193: note = MG2-78 HNH domain

SEQ ID NO: 4030 - protein, 184 aa, unidentified
  REGION 1..184: note = Description of Unknown:uncultivated organism with predicted taxonomy: Verrucomicrobiabacterium
  REGION 1..184: note = MG2-79 HNH domain
DLREMSGKTAKEKAQDLGLRIANHHAVAEKLEKAFAEERNGKSIPITAGLIRKARIAEDLGWRCPYTGIDYEPKDLVTKRVDKDHIVPRSERASDSLDSLVITLSAINKWKGKRTAWQFVEQEQGKPVPDLPNLSIVSLTRYKQFVESLETYKGHDDDKRRKKKRKELMLLPKYEEREFVPRDL

SEQ ID NO: 4031 - protein, 193 aa, unidentified; identical to SEQ ID NO: 4027
  REGION 1..193: note = Description of Unknown:uncultivated organism with predicted taxonomy: Verrucomicrobiabacterium
  REGION 1..193: note = MG2-80 HNH domain

SEQ ID NO: 4032 - protein, 185 aa, unidentified
  REGION 1..185: note = Description of Unknown:uncultivated organism with predicted taxonomy: Verrucomicrobiabacterium
  REGION 1..185: note = MG2-81 HNH domain
DLREMSGKSAKEIQQDLGRRLANHHGVAAKLDADLDGRTFNGKPIQITAGLIRKARIAEDLGWTCPYTGKTYDAIDLVSRQVDKDHIIPRSLRPSDSLDSLVVTFAEVNKMKGQRTAWKFVSDEQGKVVEGSPQLSIVSLTRFKQWAESLETYKGHDDDKRRKKKRKELLLLPNYEEKGFVPRDL

SEQ ID NO: 4033 - protein, 193 aa, unidentified; identical to SEQ ID NO: 4027
  REGION 1..193: note = Description of Unknown:uncultivated organism with predicted taxonomy: Verrucomicrobiabacterium
  REGION 1..193: note = MG2-82 HNH domain

SEQ ID NO: 4034 - protein, 182 aa, unidentified
  REGION 1..182: note = Description of Unknown:uncultivated organism
  REGION 1..182: note = MG2-83 HNH domain
DLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDL

SEQ ID NO: 4035 - protein, 187 aa, unidentified; identical to SEQ ID NO: 3960
  REGION 1..187: note = Description of Unknown:uncultivated organism with predicted taxonomy: Verrucomicrobiabacterium
  REGION 1..187: note = MG2-84 HNH domain

SEQ ID NO: 4036 - protein, 193 aa, unidentified; identical to SEQ ID NO: 4027
  REGION 1..193: note = Description of Unknown:uncultivated organism with predicted taxonomy: Verrucomicrobiabacterium
  REGION 1..193: note = MG2-85 HNH domain

SEQ ID NO: 4037 - protein, 187 aa, unidentified; identical to SEQ ID NO: 3960
  REGION 1..187: note = Description of Unknown:uncultivated organism
  REGION 1..187: note = MG2-86 HNH domain

SEQ ID NO: 4038 - protein, 187 aa, unidentified; identical to SEQ ID NO: 3960
  REGION 1..187: note = Description of Unknown:uncultivated organism with predicted taxonomy: Methylococcalesbacterium
  REGION 1..187: note = MG2-87 HNH domain

SEQ ID NO: 4039 - protein, 187 aa, unidentified; identical to SEQ ID NO: 3960
  REGION 1..187: note = Description of Unknown:uncultivated organism
  REGION 1..187: note = MG2-88 HNH domain

SEQ ID NO: 4040 - protein, 187 aa, unidentified; identical to SEQ ID NO: 3960
  REGION 1..187: note = Description of Unknown:uncultivated organism with predicted taxonomy: Verrucomicrobia
  REGION 1..187: note = MG2-89 HNH domain

SEQ ID NO: 4041 - protein, 182 aa, unidentified; identical to SEQ ID NO: 4034
  REGION 1..182: note = Description of Unknown:uncultivated organism with predicted taxonomy: Verrucomicrobiabacterium
  REGION 1..182: note = MG2-90 HNH domain

SEQ ID NO: 4042 - protein, 182 aa, unidentified; identical to SEQ ID NO: 4034
  REGION 1..182: note = Description of Unknown:uncultivated organism
  REGION 1..182: note = MG2-91 HNH domain

SEQ ID NO: 4043 - protein, 185 aa, unidentified
  REGION 1..185: note = Description of Unknown:uncultivated organism with predicted taxonomy:Verrucomicrobiae bacterium Tous-C5FEB
  REGION 1..185: note = MG2-92 HNH domain
DLREMSGKSSKEIQQDLGRRLANHHGVAAKLEKDLDGRTFNGKPIQITAGLIRKARIAEDLSWMCPYTSKAFDAIDLVSRQVDKDHIIPRSLRPSDSLDSLVVTFAEVNKMKGQRTALQFVSDEQGKTVEGSPQLSIVSLTRFKQWAESLETYKGHDDDKRRKKKRKELLLLQTYEEKGFVPRDL

SEQ ID NO: 4044 - protein, 185 aa, unidentified
  REGION 1..185: note = Description of Unknown:uncultivated organism
  REGION 1..185: note = MG2-94 HNH domain
ELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDL

SEQ ID NO: 4045 - protein, 185 aa, unidentified; identical to SEQ ID NO: 4044
  REGION 1..185: note = Description of Unknown:uncultivated organism
  REGION 1..185: note = MG2-95 HNH domain

SEQ ID NO: 4046 - protein, 185 aa, unidentified; identical to SEQ ID NO: 3956
  REGION 1..185: note = Description of Unknown:uncultivated organism
  REGION 1..185: note = MG2-96 HNH domain

SEQ ID NO: 4047 - protein, 185 aa, unidentified
  REGION 1..185: note = Description of Unknown:uncultivated organism with predicted taxonomy: Acidobacteriabacterium RIFCSPLOWO2_12_FULL_68_19
  REGION 1..185: note = MG2-97 HNH domain
ELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAFEAYVAKHTKQYRYGTDDRRRCERRAELMLMERYDQRNADFTERDL

SEQ ID NO: 4048 - protein, 186 aa, unidentified
  REGION 1..186: note = Description of Unknown:uncultivated organism with predicted taxonomy: Verrucomicrobiabacterium
  REGION 1..186: note = MG2-98 HNH domain
DLRTMSGMTAKERETEMKKRLSNFTSAKIALEKALTGKKIGGKPIPITAGLIRKARLAMDLDMTCPYTGQIYDFIDIAKGRMQRDHVIPYAERASDSLAAQVLTFAEVNKWKDKRTAAQFVREEQGKAVKGKPNLVVLPFEKYKAFVEGLDKGKHPHPDDKARKEKRKKLLLLEEYAEKEFLPADL

SEQ ID NO: 4049 - protein, 185 aa, unidentified; identical to SEQ ID NO: 3956
  REGION 1..185: note = Description of Unknown:uncultivated organism
  REGION 1..185: note = MG2-99 HNH domain

SEQ ID NO: 4050 - protein, 187 aa, unidentified
  REGION 1..187: note = Description of Unknown:uncultivated organism with predicted taxonomy: Proteobacteria
  REGION 1..187: note = MG2-100 HNH domain
ELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFICDCEKHGRDVPGHGNLQITTKKAYEAYVAKHKKQYRYGTDDRRRCERRAELMLMERYDQRNADFTERDL

SEQ ID NO: 4051 - protein, 185 aa, unidentified; identical to SEQ ID NO: 4044
  REGION 1..185: note = Description of Unknown:uncultivated organism with predicted taxonomy: Bradyrhizobium
  REGION 1..185: note = MG2-101 HNH domain

SEQ ID NO: 4052 - protein, 184 aa, unidentified
  REGION 1..184: note = Description of Unknown:uncultivated organism with predicted taxonomy: Methylococcalesbacterium
  REGION 1..184: note = MG2-102 HNH domain
DLREMSGKTAKEKAQDLGLRIANHHAVAEKLEKAFAEERNGKSIRITAGLIRKARIADDLGWKCPYTGQPYEPKHLITRFVDKDHIVPRSDRASDSLDSLVITFSAINKWKGKRTAWQFVSEEQGKPVPDLPNFSILSLARYKQFVETLETYKGHDDDKRRKKKRKELMLLPKYEEKEFVPGDL

SEQ ID NO: 4053 - protein, 182 aa, unidentified
  REGION 1..182: note = Description of Unknown:uncultivated organism with predicted taxonomy: Verrucomicrobiabacterium
  REGION 1..182: note = MG2-103 HNH domain
DLREMSGKTAKEKAQDLGLRIANHHAVSDKLEKAFAEEGKRTPITAGLIRKARIADDLGWKCPYTGQDYEPKQLVSRYVDKDHIVPRSQRASDSLDSLVITFGAINKWKGNRTAWQFVEQEQSKPVPDLPNLSILTLTRYKQFVESLETYKGHDDDKRRKKRRKDLLLLPKYEEKTFVPRDL

SEQ ID NO: 4054 - protein, 180 aa, unidentified
  REGION 1..180: note = Description of Unknown:uncultivated organism with predicted taxonomy: Verrucomicrobiabacterium
  REGION 1..180: note = MG2-104 HNH domain
ELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDL

SEQ ID NO: 4055 - protein, 180 aa, unidentified; identical to SEQ ID NO: 4054
  REGION 1..180: note = Description of Unknown:uncultivated organism with predicted taxonomy: Verrucomicrobiabacterium
  REGION 1..180: note = MG2-105 HNH domain

SEQ ID NO: 4056 - protein, 155 aa, unidentified
  REGION 1..155: note = Description of Unknown:uncultivated organism with predicted taxonomy: Rothia
  REGION 1..155: note = MG3-6 HNH domain
TGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSL

SEQ ID NO: 4057 - protein, 159 aa, unidentified
  REGION 1..159: note = Description of Unknown:uncultivated organism with predicted taxonomy: Rothia
  REGION 1..159: note = MG3-7 HNH domain
TGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSL

SEQ ID NO: 4058 - protein, 155 aa, unidentified
  REGION 1..155: note = Description of Unknown:uncultivated organism with predicted taxonomy: Rothia
  REGION 1..155: note = MG3-8 HNH domain
IGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSL

SEQ ID NO: 4059 - protein, 156 aa, unidentified
  REGION 1..156: note = Description of Unknown:uncultivated organism with predicted taxonomy: Dermabacterhominis
  REGION 1..156: note = MG3-1 HNH domain
TGLMGAEQRSSIIAENNRNRRDSDRIRAELQADGLSEPSRLDVRRHRQVQRQNCTCLYCGTPITTTTSELDHIVPRRGGGSSQGSNLVAVCRECNASKAHRIFAEWAEDSQREGVSVKEAAKRVRHWLNASASMKREVTRRLQQKRTDPPIDERDL

SEQ ID NO: 4060 - protein, 163 aa, unidentified
  REGION 1..163: note = Description of Unknown:uncultivated organism with predicted taxonomy: Micrococcales
  REGION 1..163: note = MG3-5 HNH domain
TGLMGPAQRAEVLREMASGRRKNDRIRQELRTSGIDEPNLSDVKRHRKIQMQGGVCLYCGTDITSATAELDHIVPRAGGGNSTSTNLVAVCRVCNAAKGRRTFPEFASSDTRDAVSLEAAVERVKLWIDDKGIKNIGESRYARDVIRRLKQSTQDEPIDERSL

SEQ ID NO: 4061 - protein, 155 aa, unidentified
  REGION 1..155: note = Description of Unknown:uncultivated organism with predicted taxonomy: Rothia
  REGION 1..155: note = MG3-6 HNH domain
TGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSL

SEQ ID NO: 4062 - protein, 155 aa, unidentified
  REGION 1..155: note = Description of Unknown:uncultivated organism with predicted taxonomy: Rothia
  REGION 1..155: note = MG3-7 HNH domain
TGLVGPAQRQEILNEQKKNRENNELIRGDLRKSGVENPSRAEVRRHLIVQEQESQCLYCGAVIRTDTSELDHIVPRAGGGSSRRENMAAVCHYCNSKKKRTLFYDWAGPVKLQETVDRVRQLEAFKDSKKAKMFKNQIRRLKQTEADVPIDERSL

SEQ ID NO: 4063 - protein, 155 aa, unidentified; identical to SEQ ID NO: 4058
  REGION 1..155: note = Description of Unknown:uncultivated organism with predicted taxonomy: Rothia
  REGION 1..155: note = MG3-8 HNH domain

SEQ ID NO: 4064 - protein, 162 aa, unidentified
  REGION 1..162: note = Description of Unknown:uncultivated organism with predicted taxonomy: Brevibacterium
  REGION 1..162: note = MG3-42 HNH domain
SSLLGPAARAEYQREVNANRRARERSLESLREQGVADPTVATVRRFSAVQHQNGVCLYCGSAITAKPGDSGCELDHVVPRSGGGSSKRENLVAACRRCNSEKGNLPFSLWAAESTRPEVSVEAALTRLQNFNWERRDRAVKKGLIRRLKQTSEDEPIDERSL

SEQ ID NO: 4065 - protein, 162 aa, unidentified
  REGION 1..162: note = Description of Unknown:uncultivated organism with predicted taxonomy: Brevibacteriummcbrellneri
  REGION 1..162: note = MG3-68 HNH domain
SSLLGPAARAEYQREVNANRRARERSIESLREQGVADPTVATVRRFSAVQHQNGVCLYCGSTITAKPGDSGCELDHVVPRSGGGSSKRENLVAACRRCNSEKGNLPFSIWAATCTRPEVSVEAALVRLENFNWEKRDRAVKKGLIRRLKQTSEDEPIDERSL

SEQ ID NO: 4066 - protein, 162 aa, unidentified; identical to SEQ ID NO: 4064
  REGION 1..162: note = Description of Unknown:uncultivated organism with predicted taxonomy: Brevibacteriummcbrellneri
  REGION 1..162: note = MG3-88 HNH domain

SEQ ID NO: 4067 - protein, 158 aa, unidentified
  REGION 1..158: note = Description of Unknown:uncultivated organism with predicted taxonomy: Planctomycetes
  REGION 1..158: note = MG4-5 HNH domain
DMKRGRKQRKETWQAMRENERCRLDARKLLQDHGIQEPRPADILKVLLAEECNWECPYTGKAISMDALIGSQPQFDVEHIIPFSRSLDNSFLNKTLCYHEENRNVKQNRTPFEAYGGDEQRWHEILQRVRRFRGSAAESKLRKFQLRQLPADFTNRHL

SEQ ID NO: 4068 - protein, 159 aa, unidentified
  REGION 1..159: note = Description of Unknown:uncultivated organism
  REGION 1..159: note = MG4-11 HNH domain
DLKHNVKTKSKIIAQIKSREEEREAARKGLADLGIDNPTPANIKKWVIAERCNWTCVYTGKRADKRVEFGPHPQFDIDHIQPYSRSGNDSLGNKVLCFSAENRHVKKNQTPLECYGDDEERWNEIMGRVSAITGPDRVKTYRYFITTAEENEGFTARSL

SEQ ID NO: 4069 - protein, 161 aa, unidentified
  REGION 1..161: note = Description of Unknown:uncultivated organism
  REGION 1..161: note = MG4-12 HNH domain
DLKRSRKQRDEIFRKNQARKKERENIEKTLQNEFYIKSPKGRDVLKYRLWKECGGICPYTGMVISPDDLFGPNSRFDIEHIIPFSRSMDDSFANKTLCYAEENRNVKKNQTPIECYGDSPKFREILERVRKTFTGEFKFRKLKLFETQEPESITEFSKACL

SEQ ID NO: 4070 - protein, 158 aa, unidentified
  REGION 1..158: note = Description of Unknown:uncultivated organism
  REGION 1..158: note = MG4-13 HNH domain
EMKKTRQQREEIWKKNKQNEEKRKQAAQAIIKEAGENPKPADIEKYLLWDECNGICPYTGKSISLKQLFSGEVDVEHIIPYSICLDNSYFNKTLCFHDENAKVKNNKTPWQAYGSDEKKWNEILERVKRFKGDAAKEKLKKFQIKDLEELDDFISSQL

SEQ ID NO: 4071 - protein, 160 aa, unidentified
  REGION 1..160: note = Description of Unknown:uncultivated organism
  REGION 1..160: note = MG4-14 HNH domain
DLKKSKEDRKKISDQIARNRRDRERAKKALIDNGIQEPSRDDIEKWLLYEECNGICPYTGKSISLASLFGPNPQFDVEHIIPFSRCLDNSFTNKTLCDIEENRNRKRNQTPYEAYGADPARWEEIIQRVKRFRGKAAAAKLHRFQLESVDSLEEFASKQL

SEQ ID NO: 4072 - protein, 158 aa, unidentified
  REGION 1..158: note = Description of Unknown:uncultivated organism with predicted taxonomy: Thermoguttaterrifontis
  REGION 1..158: note = MG4-15 HNH domain
ELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQL

SEQ ID NO: 4073 - protein, 158 aa, unidentified; identical to SEQ ID NO: 4072
  REGION 1..158: note = Description of Unknown:uncultivated organism with predicted taxonomy: Thermoguttaterrifontis
  REGION 1..158: note = MG4-16 HNH domain

SEQ ID NO: 4074 - protein, 158 aa, unidentified
  REGION 1..158: note = Description of Unknown:uncultivated organism with predicted taxonomy: Thermoguttaterrifontis
  REGION 1..158: note = MG4-17 HNH domain
ELKRSRKERAEISKRMREQQKRREEAAQKVLEELGRTATPRDIEKYLLAQECNWQCPYTGRQITVQSLLGDDPQFDVEHIWPLHRSLDDSFMNKTLCYHHENRSVKAGRTPYEAYATDPLRWQEILSRVRSFRGPFARQKLDRFQAVEIPPDFAMRQL

SEQ ID NO: 4075 - protein, 158 aa, unidentified
  REGION 1..158: note = Description of Unknown:uncultivated organism with predicted taxonomy: Thermoguttaterrifontis
  REGION 1..158: note = MG4-18 HNH domain
ELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLDRFQAEEIPPDFALRQL

SEQ ID NO: 4076 - protein, 160 aa, unidentified
  REGION 1..160: note = Description of Unknown:uncultivated organism
  REGION 1..160: note = MG4-19 HNH domain
DLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQL

SEQ ID NO: 4077 - protein, 160 aa, unidentified; identical to SEQ ID NO: 4076
  REGION 1..160: note = Description of Unknown:uncultivated organism
  REGION 1..160: note = MG4-20 HNH domain

SEQ ID NO: 4078 - protein, 160 aa, unidentified; identical to SEQ ID NO: 4076
  REGION 1..160: note = Description of Unknown:uncultivated organism
  REGION 1..160: note = MG4-21 HNH domain

SEQ ID NO: 4079 - protein, 160 aa, unidentified; identical to SEQ ID NO: 4076
  REGION 1..160: note = Description of Unknown:uncultivated organism with predicted taxonomy: Planctomycessp. SH-PL14
  REGION 1..160: note = MG4-22 HNH domain

SEQ ID NO: 4080 - protein, 160 aa, unidentified
  REGION 1..160: note = Description of Unknown:uncultivated organism
  REGION 1..160: note = MG4-23 HNH domain
DKKNPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQL

SEQ ID NO: 4081 - protein, 160 aa, unidentified; identical to SEQ ID NO: 4076
  REGION 1..160: note = Description of Unknown:uncultivated organism
  REGION 1..160: note = MG4-24 HNH domain

SEQ ID NO: 4082 - protein, 160 aa, unidentified; identical to SEQ ID NO: 4076
  REGION 1..160: note = Description of Unknown:uncultivated organism
  REGION 1..160: note = MG4-25 HNH domain

SEQ ID NO: 4083 - protein, 160 aa, unidentified; identical to SEQ ID NO: 4076
  REGION 1..160: note = Description of Unknown:uncultivated organism
  REGION 1..160: note = MG4-26 HNH domain

SEQ ID NO: 4084 - protein, 160 aa, unidentified; identical to SEQ ID NO: 4076
  REGION 1..160: note = Description of Unknown:uncultivated organism
  REGION 1..160: note = MG4-27 HNH domain

SEQ ID NO: 4085 - protein, 160 aa, unidentified; identical to SEQ ID NO: 4076
  REGION 1..160: note = Description of Unknown:uncultivated organism
  REGION 1..160: note = MG4-28 HNH domain

SEQ ID NO: 4086 - protein, 160 aa, unidentified; identical to SEQ ID NO: 4076
  REGION 1..160: note = Description of Unknown:uncultivated organism
  REGION 1..160: note = MG4-29 HNH domain

SEQ ID NO: 4087 - protein, 165 aa, unidentified
  REGION 1..165: note = Description of Unknown:uncultivated organism with predicted taxonomy:Alphaproteobacteria bacterium
  REGION 1..165: note = MG4-30 HNH domain
ELKKSKKQREAESKRNRENEAVRVKAKQTIKEITGDEHPSTDDVRRVQLFNDCRGTCVYCGETIAARNFLGRESQVDIDHIIPFSRSMDNSYANLVICHARCNRNKGDRTPFEAFSVDPESYGQIRDRVKIFAGDGRTVSEKIKRFEMDEGELEKFLGDFRNRQL

SEQ ID NO: 4088 - protein, 157 aa, unidentified
  REGION 1..157: note = Description of Unknown:uncultivated organism
  REGION 1..157: note = MG4-31 HNH domain
DLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHL

SEQ ID NO: 4089 - protein, 158 aa, unidentified
  REGION 1..158: note = Description of Unknown:uncultivated organism
  REGION 1..158: note = MG4-32 HNH domain
DLKSGRGRRERIANRMRDREKEREAAASAIAREIGVADPPRWMIEKHLLAEECGWRCPYTGKGFGIHDLLGRNSQFDLEHIWPFSRSLDNSYANKTICYHEENRNRKQGRTPAEAYSEEELQAILERVRAFKGDPFLIQAKLRRFTDPIEEGFTERHL

SEQ ID NO: 4090 - protein, 157 aa, unidentified; identical to SEQ ID NO: 4088
  REGION 1..157: note = Description of Unknown:uncultivated organism with predicted taxonomy:Insolitispirillum peregrinum
  REGION 1..157: note = MG4-33 HNH domain

SEQ ID NO: 4091 - protein, 161 aa, unidentified
  REGION 1..161: note = Description of Unknown:uncultivated organism with predicted taxonomy: Planctomycetesbacterium
  REGION 1..161: note = MG4-34 HNH domain
DLKRGRKEREKQSKRMAARRKQREEAKRRLLKETGIADPRRSDIERVLLADECNWICPFTGVKFGWSDLFGPTPRFDVEHIWPYSRSLDDSFLNKTICDQRENRTRKRNQTPHEAYGATPEVYERILQRVRAFSGDPWVLAAKLSRFEAESIPEGHVDRHL

SEQ ID NO: 4092 - protein, 158 aa, unidentified; identical to SEQ ID NO: 4089
  REGION 1..158: note = Description of Unknown:uncultivated organism
  REGION 1..158: note = MG4-35 HNH domain

SEQ ID NO: 4093 - protein, 166 aa, unidentified
  REGION 1..166: note = Description of Unknown:uncultivated organism with predicted taxonomy: Proteobacteria
  REGION 1..166: note = MG4-36 HNH domain
ELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRAL

SEQ ID NO: 4094 - protein, 166 aa, unidentified
  REGION 1..166: note = Description of Unknown:uncultivated organism with predicted taxonomy: Solemyavelesiana gill symbiont
  REGION 1..166: note = MG4-37 HNH domain
ELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWNEILQRVEVFKGSYSKAKLNRFKMDESAVGELFEQFSSRAL

SEQ ID NO: 4095 - protein, 166 aa, unidentified
  REGION 1..166: note = Description of Unknown:uncultivated organism with predicted taxonomy: Acidobacteria
  REGION 1..166: note = MG4-38 HNH domain
ELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHL

SEQ ID NO: 4096 - protein, 159 aa, unidentified
  REGION 1..159: note = Description of Unknown:uncultivated organism with predicted taxonomy: Planctomycetes
  REGION 1..159: note = MG4-39 HNH domain
DLKKSRHERQQLSKGMRQQQKQREDARNWLQHEMGISNPTAHDILKYRLWIECEKLCPYTGKPISKEALFGSEPQFDVEHIIPYSRCLDNSFANKTLCEVAENRAAKKNRTPYEAYGNAPQRWHEILQRVSRFRGDAAKAKLRRFQLTEIPADFANRHL

SEQ ID NO: 4097 - protein, 159 aa, unidentified
  REGION 1..159: note = Description of Unknown:uncultivated organism with predicted taxonomy: Thermoguttaterrifontis
  REGION 1..159: note = MG4-40 HNH domain
DIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHL

SEQ ID NO: 4098 - protein, 159 aa, unidentified
  REGION 1..159: note = Description of Unknown:uncultivated organism with predicted taxonomy: Planctomycetes
  REGION 1..159: note = MG4-41 HNH domain
DLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHL

SEQ ID NO: 4099 - protein, 159 aa, unidentified; identical to SEQ ID NO: 4097
  REGION 1..159: note = Description of Unknown:uncultivated organism with predicted taxonomy: Thermoguttaterrifontis
  REGION 1..159: note = MG4-42 HNH domain

SEQ ID NO: 4100 - protein, 159 aa, unidentified; identical to SEQ ID NO: 4097
  REGION 1..159: note = Description of Unknown:uncultivated organism
  REGION 1..159: note = MG4-43 HNH domain

SEQ ID NO: 4101 - protein, 170 aa, unidentified
  REGION 1..170: note = Description of Unknown:uncultivated organism with predicted taxonomy: Proteobacteria
  REGION 1..170: note = MG4-44 HNH domain
EMKQSRIQRQKRYQTMRDREKMRNQARQSLQAELGWDPNDIKGRDIEKWLLAEECSWVCPYSGKPINYHNLFGEKAEFDIEHIIPYSKSLDDSFVNKTLCHREWNQKKGNRTPAQAFKNTPEWEAMLQRVRAFKPLHAVHMKKGESSKRNPKYDLFCMEEIPPDYVDNKL

SEQ ID NO: 4102 - protein, 170 aa, unidentified; identical to SEQ ID NO: 4101
  REGION 1..170: note = Description of Unknown:uncultivated organism
  REGION 1..170: note = MG4-45 HNH domain

SEQ ID NO: 4103 - protein, 159 aa, unidentified; identical to SEQ ID NO: 4097
  REGION 1..159: note = Description of Unknown:uncultivated organism
  REGION 1..159: note = MG4-46 HNH domain

SEQ ID NO: 4104 - protein, 166 aa, unidentified
  REGION 1..166: note = Description of Unknown:uncultivated organism with predicted taxonomy: Proteobacteria
  REGION 1..166: note = MG4-47 HNH domain
ELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRAL

SEQ ID NO: 4105 - protein, 160 aa, unidentified
  REGION 1..160: note = Description of Unknown:uncultivated organism
  REGION 1..160: note = MG4-48 HNH domain
DLRRPLCEVREMIKQMRKREKMRREAERKLCEEHGIRKPTAREIEKYLLWKECNARCPYTNQDIRAEALFGSHPRFDVEHIIPWSRCLDDSFANKTLCEAKHNREQKRNRMPTEAYSREALEQIWERVRRFQGDYAAEKLRRFQMDPPPELHLIHRGDQL

SEQ ID NO: 4106 - protein, 159 aa, unidentified; identical to SEQ ID NO: 4098
  REGION 1..159: note = Description of Unknown:uncultivated organism
  REGION 1..159: note = MG4-49 HNH domain

SEQ ID NO: 4107 - protein, 166 aa, unidentified
  REGION 1..166: note = Description of Unknown:uncultivated organism with predicted taxonomy: Solemyavelesiana gill symbiont
  REGION 1..166: note = MG4-51 HNH domain
ELRKSREEREKDSKRMREHEKEREAIIRRICEEIGIPETGISRDDVRKAMLWEECNGMCPYSGRSLGGFASLFSGNSPAQIEHIIPFSRSLDNSFVNLTLAHVSENAYKGDKTPWEAYGSNPEQWDRILQRVALFKGSYKKAKLNRFKMDSNAVGEFLEQFSSRAL

SEQ ID NO: 4108 - protein, 166 aa, unidentified
  REGION 1..166: note = Description of Unknown:uncultivated organism
  REGION 1..166: note = MG4-52 HNH domain
ELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQWVEVFKGSYSKAKLNRFKMDESAVGELFEQFSSRAL

SEQ ID NO: 4109 - protein, 161 aa, unidentified
  REGION 1..161: note = Description of Unknown:uncultivated organism
  REGION 1..161: note = MG4-53 HNH domain
EVKKNARQRHQIALRNRENERLRRAAAERIVREVGIANPSRADIEKVLLAEECNWHCPYTGKPISMAALFGEHPQFDVEHIIPFARSLDDSFMNKTLCDAEENRRVKRGRTPFEAYGSQPERWAEILRRVRAFKGSAADAKLERFRCESPPDATELCSRLL

SEQ ID NO: 4110 - protein, 166 aa, unidentified; identical to SEQ ID NO: 4095
  REGION 1..166: note = Description of Unknown:uncultivated organism
  REGION 1..166: note = MG4-54 HNH domain

SEQ ID NO: 4111 - protein, 170 aa, unidentified
  REGION 1..170: note = Description of Unknown:uncultivated organism with predicted taxonomy: Flavobacteriumhercynium
  REGION 1..170: note = MG4-55 HNH domain
EMKQSRIQRQKRYQTMRDREKMRNQARQSLQAELGWDPNDIKGRDIEKWLLAEECGWVCPYSGKPINYHNLFGEKAEFDIEHIIPYSKSLDDSFVNKTLCHREWNQKKGNRTPAQAFKNTPEWETMLQRVRAFKPLHAVHMKKGESSKHNPKYDLFCMEEIPPDYVDNKL

SEQ ID NO: 4112 - protein, 166 aa, unidentified; identical to SEQ ID NO: 4093
  REGION 1..166: note = Description of Unknown:uncultivated organism with predicted taxonomy:Pseudoxanthobacter soli
  REGION 1..166: note = MG4-56 HNH domain

SEQ ID NO: 4113 - protein, 161 aa, unidentified
  REGION 1..161: note = Description of Unknown:uncultivated organism with predicted taxonomy: candidatedivision Zixibacteria bacterium CG_4_9_14_3_um_filter_46_8
  REGION 1..161: note = MG4-57 HNH domain
DLKRSKKQRQTLTERIRSREKLREDARKRLENEKLVERPTRNDIDKVLLADECNWICPYTGRQIGWKTLFGPSPQFDIEHIIPFSRCLDDSLANKTLCDIEENRNVKRNRTPWEAYGSNPEKWGQILDRVRRFKGDDAILKLQRFQLKDVGDFEEFSSRQL

SEQ ID NO: 4114 - protein, 166 aa, unidentified
  REGION 1..166: note = Description of Unknown:uncultivated organism
  REGION 1..166: note = MG4-58 HNH domain
ELRKSREERMKESRRMRDREKEREEIIRRIRDEVGIPEEKISRDDVLKGLLWQECEGRCPYCGESLGGFASLFGGNPPAQIEHIIPFSRSLDNSFVNLTLAHVSDNAYKGDRTPREAYGSDPERWNEILQRVEVFKGSYSKAKLNRFKMDESAVGELFEQFSSRAL

SEQ ID NO: 4115 - protein, 166 aa, unidentified; identical to SEQ ID NO: 4104
  REGION 1..166: note = Description of Unknown:uncultivated organism with predicted taxonomy: Proteobacteria
  REGION 1..166: note = MG4-60 HNH domain

SEQ ID NO: 4116 - protein, 159 aa, unidentified; identical to SEQ ID NO: 4097
  REGION 1..159: note = Description of Unknown:uncultivated organism with predicted taxonomy: Thermoguttaterrifontis
  REGION 1..159: note = MG4-61 HNH domain

SEQ ID NO: 4117 - protein, 162 aa, unidentified
  REGION 1..162: note = Description of Unknown:uncultivated organism
  REGION 1..162: note = MG4-62 HNH domain
DLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHL

SEQ ID NO: 4118 - protein, 157 aa, unidentified
  REGION 1..157: note = Description of Unknown:uncultivated organism with predicted taxonomy: Planctomycessp. SH-PL14
  REGION 1..157: note = MG4-63 HNH domain
DLKNSRSRRADLTTRRNRNQARRERAKEAIEKECNNSRPSRFDIEKWLLAEECGFQCPYTGQSIPRHRVLSAEFEVEHIVPFSRSLDNSFTNKTLSHRDANAKKGNRTPMEAFGQPEEKWEQILARVKRFDGPFARRKLDLFQQRTPPEADFYERQL

SEQ ID NO: 4119 - protein, 162 aa, unidentified; identical to SEQ ID NO: 4117
  REGION 1..162: note = Description of Unknown:uncultivated organism
  REGION 1..162: note = MG4-64 HNH domain

SEQ ID NO: 4120 - protein, 159 aa, unidentified
  REGION 1..159: note = Description of Unknown:uncultivated organism
  REGION 1..159: note = MG4-65 HNH domain
DLKRPRKQREEISKRNRGRQKDREEAAEAIRSALPGLEPRRADIEKWLLAEECNWRCPYTGRSINAAALLGSTPQFDVEHIWPMSRSLDNTFANKTLCYHEENRARKGNRTPLEAYGSDPQRWEEILQSVRRFNGPLAWEKLRRFMAREIPQDFTDRQL

SEQ ID NO: 4121 - protein, 159 aa, unidentified
  REGION 1..159: note = Description of Unknown:uncultivated organism
  REGION 1..159: note = MG4-66 HNH domain
DLKKSRYERQQLFKGMRQQQKQREEAKSWLQCQMGITNPTAHDILKYRLWIECNQQCPYTGKPISKEALFGREPQFDVEHIIPFSRCLDNSFTNKTLCEIAENRNVKKNRTPYEAYGHDPQRWHEILQRVSRFQGDAAKAKLRRFQLTEIPADFANRHL

SEQ ID NO: 4122 - protein, 159 aa, unidentified
  REGION 1..159: note = Description of Unknown:uncultivated organism with predicted taxonomy: Proteobacteria
  REGION 1..159: note = MG4-67 HNH domain
DLKRSRKDRQELSKVIRENEKLREKAKERILRELGDQQPTRADIEKVLLAEECGWECPYTGKRFGMQELLGQNPQFDVEHIIPLSRSLDNSFGNKTLCYHEENRNHKRNRTPWEAYHADEQRWHQILERVRRFQGASARGKMRRFLMEAIPDDFTSRQL

SEQ ID NO: 4123 - protein, 158 aa, unidentified
  REGION 1..158: note = Description of Unknown:uncultivated organism with predicted taxonomy: Thermoguttaterrifontis
  REGION 1..158: note = MG4-68 HNH domain
ELKLGKKRRQELAKEMRKREAERERAAKVIEETLHRKARPNEILKYLLADECDWECPYTGKKISVLTLLGDQPQFDVEHIWPFDRTLDDSFGNKTLCYHEENRQVKGNKTPFEAYSDSPDRWREILERVKRFKGPFAKEKLRRFLAADIPQDFPMRHL

SEQ ID NO: 4124 - protein, 166 aa, unidentified
  REGION 1..166: note = Description of Unknown:uncultivated organism with predicted taxonomy: Planctomycetesbacterium
  REGION 1..166: note = MG4-70 HNH domain
ELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRAL

SEQ ID NO: 4125 - protein, 165 aa, unidentified
  REGION 1..165: note = Description of Unknown:uncultivated organism
  REGION 1..165: note = MG4-71 HNH domain
DLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHL

SEQ ID NO: 4126 - protein, 167 aa, unidentified
  REGION 1..167: note = Description of Unknown:uncultivated organism with predicted taxonomy: Acidobacteria
  REGION 1..167: note = MG4-72 HNH domain
DLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQL

SEQ ID NO: 4127 - protein, 165 aa, unidentified; identical to SEQ ID NO: 4125
  REGION 1..165: note = Description of Unknown:uncultivated organism
  REGION 1..165: note = MG4-73 HNH domain

SEQ ID NO: 4128 - protein, 167 aa, unidentified; identical to SEQ ID NO: 4126
  REGION 1..167: note = Description of Unknown:uncultivated organism with predicted taxonomy: Acidobacteria
  REGION 1..167: note = MG4-74 HNH domain

SEQ ID NO: 4129 - protein, 166 aa, unidentified; identical to SEQ ID NO: 4124
  REGION 1..166: note = Description of Unknown:uncultivated organism with predicted taxonomy: Proteobacteria
  REGION 1..166: note = MG4-76 HNH domain

SEQ ID NO: 4130 - protein, 166 aa, unidentified
  REGION 1..166: note = Description of Unknown:uncultivated organism
  REGION 1..166: note = MG4-77 HNH domain
ELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHL

SEQ ID NO: 4131 - protein, 162 aa, unidentified
  REGION 1..162: note = Description of Unknown:uncultivated organism
  REGION 1..162: note = MG4-78 HNH domain
ELRKPLRRLRELLRRNEERQRQRKHAIKYLIEKGIQDPRPDQIEKFLLWVECKQICPYTGQSISDVDLFGPLPRFDVEHIIPWSRCLDDSFANKTLCEVDHNRNRKRNRMPTEVYSQDELSQILRRVRAFQGPYRFEKLRRFQMTEADLTTETGWLLRGDQL

SEQ ID NO: 4132 - protein, 162 aa, unidentified; identical to SEQ ID NO: 4131
  REGION 1..162: note = Description of Unknown:uncultivated organism
  REGION 1..162: note = MG4-79 HNH domain

SEQ ID NO: 4133 - protein, 161 aa, unidentified
  REGION 1..161: note = Description of Unknown:uncultivated organism with predicted taxonomy: Planctomycetes
  REGION 1..161: note = MG4-80 HNH domain
DLRRSRKEREKISAEQAKREKARRDALQKMLREFPNYQPKRGYDPAIEKILLAEECDWECPFTGKKINMQTLLGKSPQFDVAHIYPRRYLDDSFANKTLCYHEENRHRMLDRLPMEAYAGNPQRWQEILARVKRFQGPYAAEKLRRFQTEKVPDDFVSRQL

SEQ ID NO: 4134 - protein, 166 aa, unidentified; identical to SEQ ID NO: 4130
  REGION 1..166: note = Description of Unknown:uncultivated organism with predicted taxonomy:Rhodobacteraceae
  REGION 1..166: note = MG4-81 HNH domain

SEQ ID NO: 4135 - protein, 158 aa, unidentified
  REGION 1..158: note = Description of Unknown:uncultivated organism
  REGION 1..158: note = MG4-82 HNH domain
DLKQPRKVREERSKSMRKNEALRQQIIDDIRRFGIANPSETDILKVRLADECNWQCPYTGKAISMETLLGPHPQFDIEHIQPYSRSLDNSFTNKTLCDVHENRIAKRNLTPFEAYSGDEQRWHEIIARVRRFRGPASPAKLRKFLAKAIDSDFVERQL

SEQ ID NO: 4136 - protein, 164 aa, unidentified
  REGION 1..164: note = Description of Unknown:uncultivated organism
  REGION 1..164: note = MG4-83 HNH domain
DMKRPRKARQQISKRIRANKNKRDAARQQLLKEASGALGSAWEPKRSDIEKWLLRDECGGICPYTGKPISFHSLFVEPEFDIEHIIPFSRSLDNSFLNKTLCCATENRIKSKRTPWEAYGGTARWDEIIGRVRKFTGDANVAKLQRFQIRDADKEIDGFAAREL

SEQ ID NO: 4137 - protein, 161 aa, unidentified
  REGION 1..161: note = Description of Unknown:uncultivated organism
  REGION 1..161: note = MG4-84 HNH domain
DLRKSPKQREQTWKKNRDNEALRKDAAEKLFREMGIQNPKRSDIEKMLLLQECGCMCPYTGKHISMRDLFGDAPQFDVEHIVPFSRSLDDSFLNKTLCEVAENRNVKGNRTPWEAYGHDLVRWNQILQRVSHFQGSAQREKLRRFQLQTIESPEQFASSQL

SEQ ID NO: 4138 - protein, 162 aa, unidentified; identical to SEQ ID NO: 4131
  REGION 1..162: note = Description of Unknown:uncultivated organism
  REGION 1..162: note = MG4-85 HNH domain

SEQ ID NO: 4139 - protein, 162 aa, unidentified; identical to SEQ ID NO: 4131
  REGION 1..162: note = Description of Unknown:uncultivated organism
  REGION 1..162: note = MG4-86 HNH domain

SEQ ID NO: 4140 - protein, 161 aa, unidentified
  REGION 1..161: note = Description of Unknown:uncultivated organism
  REGION 1..161: note = MG4-87 HNH domain
DLKHGRDRRAAITKQIRQREKQHADAKHRILAEIKGYEPTRIDREKVLLADECDWRCPYTGKKFGMKELIGEHPQVDVEHIWPFSRSFDNSFMNKTLCWHDENRRVKRGRTPYEAYSASPERYQEILGRVLAFKSDRRTVSEKFRRFTAEAIDEDFTNRHL

SEQ ID NO: 4141 - protein, 161 aa, unidentified
  REGION 1..161: note = Description of Unknown:uncultivated organism with predicted taxonomy: Planctomycetesbacterium
  REGION 1..161: note = MG4-88 HNH domain
DLRRSRKDRKRIAEQQREQETRRRKALERMMREFPNYQAKAGFDPAIEKILLAEECNWECPFTGRKIEMATLLGKNAQFDVAHLFPRRYLDDSFLNKTLCYHDENRHRMHDLLPKQAYGGDPQRWAEIIARVKAFKGSAATLKLERFLAAEVPEDFVESQL

SEQ ID NO: 4142 - protein, 161 aa, unidentified
  REGION 1..161: note = Description of Unknown:uncultivated organism with predicted taxonomy:Planctomicrobium piriforme
  REGION 1..161: note = MG4-89 HNH domain
DLKRARKQRERLSKEMREQEARRDSARAAIVRKAGLAGPSRSDIERYILAEECGFICPYTGKPMDRERLTDLVGRTPQFDVEHIWPLSRSLDDSYLNKTLCHVEENKAKGNRTPFEAYSQSPERWEQILDRVKRFGGTAARIKLERFTAKEIPDGFAERHL

SEQ ID NO: 4143 - protein, 162 aa, unidentified; identical to SEQ ID NO: 4117
  REGION 1..162: note = Description of Unknown:uncultivated organism
  REGION 1..162: note = MG4-90 HNH domain

SEQ ID NO: 4144 - protein, 166 aa, unidentified
  REGION 1..166: note = Description of Unknown:uncultivated organism with predicted taxonomy:Deltaproteobacteria bacterium
  REGION 1..166: note = MG4-91 HNH domain
ELKHGRSRREQTERRMRERAKQREAAAETIIRETTARGFRIDKPRRDDIEKYLLAEECGWICPYTGRSIGWESLFGPHPEFDIEHIWPFSRSLDNRFLNKRLCHAATNRSVKKNRTPYEAFGQDTEQWEQILDRVRRFKGDPYARREKLRRFEAQEIDEGFLERHL

SEQ ID NO: 4145 - protein, 158 aa, unidentified
  REGION 1..158: note = Description of Unknown:uncultivated organism with predicted taxonomy:Alphaproteobacteria
  REGION 1..158: note = MG4-92 HNH domain
DIKLGRKRRAEISKKMRTRQSEREDAKEQLRQWGVPVTHDAIERELLRRECNGVCPYTGREISPSQLFGESPQFDIEHIIPYSRSLDNSFANKTLCWHATNRNRKRGKTPYEVFSQDGDWEVILRRVAAFKGGYRDEKLRRFKLADLSEFDDFERRQL

SEQ ID NO: 4146 - protein, 158 aa, unidentified
  REGION 1..158: note = Description of Unknown:uncultivated organism with predicted taxonomy: Proteobacteria
  REGION 1..158: note = MG4-93 HNH domain
DIKLGRKRRAEISKKMRTRQSEREDAKEQLRQWGVPVTRDAIERELLRRECNGVCPYTGREISPSHLFGESPQFDIEHIIPYSRSLDNSFANKTLCWHATNRNRKRGKTPYEVFSQDGDWEVILRRVAAFKGGYRDEKLRRFKLADLSEFDDFERRQL

SEQ ID NO: 4147 - protein, 165 aa, unidentified
  REGION 1..165: note = Description of Unknown:uncultivated organism with predicted taxonomy:Planctomycetales bacterium 4484_113
  REGION 1..165: note = MG4-94 HNH domain
DVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQL

SEQ ID NO: 4148 - protein, 161 aa, unidentified
  REGION 1..161: note = Description of Unknown:uncultivated organism with predicted taxonomy: Planctomycetesbacterium
  REGION 1..161: note = MG4-95 HNH domain
DLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQL

SEQ ID NO: 4149 - protein, 165 aa, unidentified; identical to SEQ ID NO: 4147
  REGION 1..165: note = Description of Unknown:uncultivated organism with predicted taxonomy:Planctomycetales bacterium 4484_113
  REGION 1..165: note = MG4-96 HNH domain

SEQ ID NO: 4150 - protein, 164 aa, unidentified
  REGION 1..164: note = Description of Unknown:uncultivated organism with predicted taxonomy: Planctomycetesbacterium
  REGION 1..164: note = MG4-97 HNH domain
DLKAPKQIRLRRSRQMRRNEAERKSARKELIEQGLPEPTGRDIEKYRLWKECGKRCPYTGKMISFSDLFGPHPKFDIEHIIPWHRCLLDSFANKTLCEVQENRSRKGNRTPYEAYSGDPDRYEEIKQRVREFTGPFGKAKLRRFRCEDIQKLPESLPLYGGEQL

SEQ ID NO: 4151 - protein, 163 aa, unidentified
  REGION 1..163: note = Description of Unknown:uncultivated organism
  REGION 1..163: note = MG4-98 HNH domain
ELKQSPKQRQETTKRMRRNEKERNDIREQIRNETGIENPTYTDILKVRLAKECNWECPYTGTHISMQQLIGPHPQFDIEHIIPHYRSLDNSFTNLTLCEARENREVKRNRTPYEAYHDTAKWEDIIRRVERFDGPMRNAKLRRFLLQGEELEKFLDGFTNRQL

SEQ ID NO: 4152 - protein, 161 aa, unidentified; identical to SEQ ID NO: 4148
  REGION 1..161: note = Description of Unknown:uncultivated organism with predicted taxonomy: Planctomycetesbacterium
  REGION 1..161: note = MG4-99 HNH domain

SEQ ID NO: 4153 - protein, 161 aa, unidentified; identical to SEQ ID NO: 4148
  REGION 1..161: note = Description of Unknown:uncultivated organism with predicted taxonomy: Planctomycetesbacterium
  REGION 1..161: note = MG4-100 HNH domain

SEQ ID NO: 4154 - protein, 163 aa, unidentified; identical to SEQ ID NO: 4151
  REGION 1..163: note = Description of Unknown:uncultivated organism
  REGION 1..163: note = MG4-101 HNH domain

SEQ ID NO: 4155 - protein, 163 aa, unidentified
  REGION 1..163: note = Description of Unknown:uncultivated organism
  REGION 1..163: note = MG4-102 HNH domain
EMKLSANRKKEIIKRNRDLEKQREKAAEKIRDVFPGMTPGRTDTTKVLLAEECGWRCPYTGRSISIRTLFGPHPQFDIEHIIPRSRSLDDSFLNKTLCYHEENRNVKRNRTPYEAYHGTPRYDEILDRVAKFNGRLAKEKLRRFRMTPEEVEDRFADFTQRQL

SEQ ID NO: 4156 - protein, 163 aa, unidentified; identical to SEQ ID NO: 4155
  REGION 1..163: note = Description of Unknown:uncultivated organism
  REGION 1..163: note = MG4-103 HNH domain

SEQ ID NO: 4157 - protein, 156 aa, unidentified
  REGION 1..156: note = Description of Unknown:uncultivated organism with predicted taxonomy: Planctomycetesbacterium
  REGION 1..156: note = MG4-104 HNH domain
DLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNL

SEQ ID NO: 4158 - protein, 156 aa, unidentified
  REGION 1..156: note = Description of Unknown:uncultivated organism
  REGION 1..156: note = MG4-105 HNH domain
DLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNL

SEQ ID NO: 4159 - protein, 156 aa, unidentified
  REGION 1..156: note = Description of Unknown:uncultivated organism
  REGION 1..156: note = MG4-106 HNH domain
DLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNL

SEQ ID NO: 4160 - protein, 156 aa, unidentified; identical to SEQ ID NO: 4159
  REGION 1..156: note = Description of Unknown:uncultivated organism
  REGION 1..156: note = MG4-107 HNH domain

SEQ ID NO: 4161 - protein, 156 aa, unidentified; identical to SEQ ID NO: 4158
  REGION 1..156: note = Description of Unknown:uncultivated organism
  REGION 1..156: note = MG4-108 HNH domain

SEQ ID NO: 4162 - protein, 156 aa, unidentified; identical to SEQ ID NO: 4157
  REGION 1..156: note = Description of Unknown:uncultivated organism with predicted taxonomy: Planctomycetesbacterium
  REGION 1..156: note = MG4-109 HNH domain

SEQ ID NO: 4163 - protein, 156 aa, unidentified
  REGION 1..156: note = Description of Unknown:uncultivated organism
  REGION 1..156: note = MG4-110 HNH domain
DLKNSSKDRENIARRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKLQKAESRDFIERNL

SEQ ID NO: 4164 - protein, 156 aa, unidentified
  REGION 1..156: note = Description of Unknown:uncultivated organism with predicted taxonomy: Planctomycetesbacterium
  REGION 1..156: note = MG4-111 HNH domain
DLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYAEIIERVRHFKGSFAKIKLEKFELETAEVQDFINRNL

SEQ ID NO: 4165 - protein, 156 aa, unidentified; identical to SEQ ID NO: 4158
  REGION 1..156: note = Description of Unknown:uncultivated organism
  REGION 1..156: note = MG4-112 HNH domain

SEQ ID NO: 4166 - protein, 156 aa, unidentified; identical to SEQ ID NO: 4159
  REGION 1..156: note = Description of Unknown:uncultivated organism
  REGION 1..156: note = MG4-113 HNH domain

SEQ ID NO: 4167 - protein, 156 aa, unidentified; identical to SEQ ID NO: 4158
  REGION 1..156: note = Description of Unknown:uncultivated organism
  REGION 1..156: note = MG4-114 HNH domain

SEQ ID NO: 4168 - protein, 156 aa, unidentified; identical to SEQ ID NO: 4158
  REGION 1..156: note = Description of Unknown:uncultivated organism
  REGION 1..156: note = MG4-115 HNH domain

SEQ ID NO: 4169 - protein, 159 aa, unidentified
  REGION 1..159: note = Description of Unknown:uncultivated organism
  REGION 1..159: note = MG4-116 HNH domain
DLKKPRQERARATDLNRKRQRERDSVKERIVREGGLERPSRDDIEKVLLWEECGGICPYTGKSIAFASLFGEHPQFGVEHIIPFSRLPDNSFQNKTLCDHEQGRNVKRNKTPFEAYPNTEEYDAILTRIKAWETPNLGKQKRFELRTLEELEGFSTRQL

SEQ ID NO: 4170 - protein, 157 aa, unidentified
  REGION 1..157: note = Description of Unknown:uncultivated organism with predicted taxonomy:Acidobacteriales bacterium 59-55
  REGION 1..157: note = MG4-117 HNH domain
ELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQM

SEQ ID NO: 4171 - protein, 159 aa, unidentified; identical to SEQ ID NO: 4169
  REGION 1..159: note = Description of Unknown:uncultivated organism
  REGION 1..159: note = MG4-118 HNH domain

SEQ ID NO: 4172 - protein, 157 aa, unidentified; identical to SEQ ID NO: 4170
  REGION 1..157: note = Description of Unknown:uncultivated organism
  REGION 1..157: note = MG4-119 HNH domain

SEQ ID NO: 4173 - protein, 159 aa, unidentified; identical to SEQ ID NO: 4169
  REGION 1..159: note = Description of Unknown:uncultivated organism
  REGION 1..159: note = MG4-120 HNH domain

SEQ ID NO: 4174 - protein, 157 aa, unidentified
  REGION 1..157: note = Description of Unknown:uncultivated organism with predicted taxonomy:Acidobacteriales bacterium 59-55
  REGION 1..157: note = MG4-121 HNH domain
ELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMSRFAIQTEEALGDFSARQM

SEQ ID NO: 4175 - protein, 157 aa, unidentified
  REGION 1..157: note = Description of Unknown:uncultivated organism with predicted taxonomy: unculturedbacterium
  REGION 1..157: note = MG4-122 HNH domain
ELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQM

SEQ ID NO: 4176 - protein, 159 aa, unidentified; identical to SEQ ID NO: 4169
  REGION 1..159: note = Description of Unknown:uncultivated organism
  REGION 1..159: note = MG4-123 HNH domain

SEQ ID NO: 4177 - protein, 159 aa, unidentified; identical to SEQ ID NO: 4169
  REGION 1..159: note = Description of Unknown:uncultivated organism
  REGION 1..159: note = MG4-124 HNH domain

SEQ ID NO: 4178 - protein, 159 aa, unidentified; identical to SEQ ID NO: 4169
  REGION 1..159: note = Description of Unknown:uncultivated organism
  REGION 1..159: note = MG4-125 HNH domain

SEQ ID NO: 4179 - protein, 160 aa, unidentified
  REGION 1..160: note = Description of Unknown:uncultivated organism
  REGION 1..160: note = MG4-126 HNH domain
DLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQL

SEQ ID NO: 4180 - protein, 157 aa, unidentified; identical to SEQ ID NO: 4175
  REGION 1..157: note = Description of Unknown:uncultivated organism
  REGION 1..157: note = MG4-127 HNH domain

SEQ ID NO: 4181 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-128 HNH domain

SEQ ID NO: 4182 - protein, 160 aa, unidentified
  REGION 1..160: note = Description of Unknown:uncultivated organism
  REGION 1..160: note = MG4-129 HNH domain
ELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQL

SEQ ID NO: 4183 - protein, 161 aa, unidentified
  REGION 1..161: note = Description of Unknown:uncultivated organism with predicted taxonomy: Planctomycetes
  REGION 1..161: note = MG4-130 HNH domain
DLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARML

SEQ ID NO: 4184 - protein, 157 aa, unidentified; identical to SEQ ID NO: 4170
  REGION 1..157: note = Description of Unknown:uncultivated organism
  REGION 1..157: note = MG4-131 HNH domain

SEQ ID NO: 4185 - protein, 165 aa, unidentified
  REGION 1..165: note = Description of Unknown:uncultivated organism with predicted taxonomy: Planctomycetesbacterium
  REGION 1..165: note = MG4-132 HNH domain
ELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQL

SEQ ID NO: 4186 - protein, 160 aa, unidentified; identical to SEQ ID NO: 4179
  REGION 1..160: note = Description of Unknown:uncultivated organism
  REGION 1..160: note = MG4-133 HNH domain

SEQ ID NO: 4187 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-134 HNH domain

SEQ ID NO: 4188 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-135 HNH domain

SEQ ID NO: 4189 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-136 HNH domain

SEQ ID NO: 4190 - protein, 165 aa, unidentified; identical to SEQ ID NO: 4185
  REGION 1..165: note = Description of Unknown:uncultivated organism with predicted taxonomy:Acidobacteriales bacterium 59-55
  REGION 1..165: note = MG4-137 HNH domain

SEQ ID NO: 4191 - protein, 160 aa, unidentified
  REGION 1..160: note = Description of Unknown:uncultivated organism with predicted taxonomy: unculturedbacterium
  REGION 1..160: note = MG4-138 HNH domain
DLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQL

SEQ ID NO: 4192 - protein, 158 aa, unidentified
  REGION 1..158: note = Description of Unknown:uncultivated organism
  REGION 1..158: note = MG4-139 HNH domain
ELKKSRRERMESVSTNRDREKQRNAAKEKLLKELGLQHPSRADIEKALLWEECQGVCPYTGKQFPFSSLFGENPSMQVQHIIPFSRIPDDSFQNKTLCSVEENQYKANRTPFEAYADPAQYEAILDRVKNWPRPNRGKQRRFELRTLEELEGFSSRQL

SEQ ID NO: 4193 - protein, 168 aa, unidentified
  REGION 1..168: note = Description of Unknown:uncultivated organism with predicted taxonomy: Planctomycetesbacterium
  REGION 1..168: note = MG4-140 HNH domain
ELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRL

SEQ ID NO: 4194 - protein, 160 aa, unidentified; identical to SEQ ID NO: 4179
  REGION 1..160: note = Description of Unknown:uncultivated organism
  REGION 1..160: note = MG4-141 HNH domain

SEQ ID NO: 4195 - protein, 160 aa, unidentified; identical to SEQ ID NO: 4182
  REGION 1..160: note = Description of Unknown:uncultivated organism with predicted taxonomy: Polaribactersp. ALD11
  REGION 1..160: note = MG4-142 HNH domain

SEQ ID NO: 4196 - protein, 157 aa, unidentified; identical to SEQ ID NO: 4170
  REGION 1..157: note = Description of Unknown:uncultivated organism
  REGION 1..157: note = MG4-143 HNH domain

SEQ ID NO: 4197 - protein, 157 aa, unidentified; identical to SEQ ID NO: 4175
  REGION 1..157: note = Description of Unknown:uncultivated organism
  REGION 1..157: note = MG4-144 HNH domain

SEQ ID NO: 4198 - protein, 160 aa, unidentified; identical to SEQ ID NO: 4179
  REGION 1..160: note = Description of Unknown:uncultivated organism
  REGION 1..160: note = MG4-145 HNH domain

SEQ ID NO: 4199 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-146 HNH domain

SEQ ID NO: 4200 - protein, 160 aa, unidentified; identical to SEQ ID NO: 4179
  REGION 1..160: note = Description of Unknown:uncultivated organism
  REGION 1..160: note = MG4-147 HNH domain

SEQ ID NO: 4201 - protein, 157 aa, unidentified; identical to SEQ ID NO: 4170
  REGION 1..157: note = Description of Unknown:uncultivated organism
  REGION 1..157: note = MG4-148 HNH domain

SEQ ID NO: 4202 - protein, 157 aa, unidentified; identical to SEQ ID NO: 4170
  REGION 1..157: note = Description of Unknown:uncultivated organism
  REGION 1..157: note = MG4-149 HNH domain

SEQ ID NO: 4203 - protein, 160 aa, unidentified
  REGION 1..160: note = Description of Unknown:uncultivated organism with predicted taxonomy: Polaribactersp. ALD11
  REGION 1..160: note = MG4-150 HNH domain
ELKKPRSKRLDETARNRKREAENKALAERMHNECGMPQNSSRNDLEKAKLWVEQQGQCPYTGRSLPFSRLFDDNNGFDVDHILPRSRHPDDSYQNKVLCWGDTNRMVKRNQTPYEAFAEQDPENWHQILARVARWKNPGKSRKFEIRSTDELAEFSSRQL

SEQ ID NO: 4204 - protein, 165 aa, unidentified; identical to SEQ ID NO: 4185
  REGION 1..165: note = Description of Unknown:uncultivated organism with predicted taxonomy:Acidobacteriales
  REGION 1..165: note = MG4-151 HNH domain

SEQ ID NO: 4205 - protein, 160 aa, unidentified; identical to SEQ ID NO: 4179
  REGION 1..160: note = Description of Unknown:uncultivated organism
  REGION 1..160: note = MG4-152 HNH domain

SEQ ID NO: 4206 - protein, 157 aa, unidentified; identical to SEQ ID NO: 4170
  REGION 1..157: note = Description of Unknown:uncultivated organism
  REGION 1..157: note = MG4-153 HNH domain

SEQ ID NO: 4207 - protein, 157 aa, unidentified
  REGION 1..157: note = Description of Unknown:uncultivated organism with predicted taxonomy:Acidobacteriales bacterium 59-55
  REGION 1..157: note = MG4-154 HNH domain
ELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQM

SEQ ID NO: 4208 - protein, 161 aa, unidentified
  REGION 1..161: note = Description of Unknown:uncultivated organism with predicted taxonomy:Deltaproteobacteria
  REGION 1..161: note = MG4-155 HNH domain
DLKASRPEREDRWARMRRNEKARAEAAAKIQSEIGIHTPGRADTEKWLLAEECHWRCPYSGRGFSATQLYQSGEIQVEHIIPFSRSLDDSFANKTLAYSWVNKAKGNRSPREAFQEQSQWEAILTEVGSFHGPYAKHKLQRFQWTSEQIAELLDDFTKRQL

SEQ ID NO: 4209 - protein, 163 aa, unidentified
  REGION 1..163: note = Description of Unknown:uncultivated organism with predicted taxonomy: Planctomycetesbacterium
  REGION 1..163: note = MG4-156 HNH domain
ELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQL

SEQ ID NO: 4210 - protein, 157 aa, unidentified; identical to SEQ ID NO: 4170
  REGION 1..157: note = Description of Unknown:uncultivated organism
  REGION 1..157: note = MG4-157 HNH domain

SEQ ID NO: 4211 - protein, 157 aa, unidentified; identical to SEQ ID NO: 4170
  REGION 1..157: note = Description of Unknown:uncultivated organism
  REGION 1..157: note = MG4-158 HNH domain

SEQ ID NO: 4212 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-159 HNH domain

SEQ ID NO: 4213 - protein, 161 aa, unidentified; identical to SEQ ID NO: 4183
  REGION 1..161: note = Description of Unknown:uncultivated organism with predicted taxonomy: Planctomycetes
  REGION 1..161: note = MG4-160 HNH domain

SEQ ID NO: 4214 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-161 HNH domain

SEQ ID NO: 4215 - protein, 160 aa, unidentified; identical to SEQ ID NO: 4076
  REGION 1..160: note = Description of Unknown:uncultivated organism
  REGION 1..160: note = MG4-162 HNH domain

SEQ ID NO: 4216 - protein, 160 aa, unidentified; identical to SEQ ID NO: 4182
  REGION 1..160: note = Description of Unknown:uncultivated organism with predicted taxonomy:Acidobacteriales bacterium 59-55
  REGION 1..160: note = MG4-163 HNH domain

SEQ ID NO: 4217 - protein, 160 aa, unidentified; identical to SEQ ID NO: 4179
  REGION 1..160: note = Description of Unknown:uncultivated organism
  REGION 1..160: note = MG4-164 HNH domain

SEQ ID NO: 4218 - protein, 157 aa, unidentified; identical to SEQ ID NO: 4170
  REGION 1..157: note = Description of Unknown:uncultivated organism
  REGION 1..157: note = MG4-165 HNH domain

SEQ ID NO: 4219 - protein, 157 aa, unidentified; identical to SEQ ID NO: 4207
  REGION 1..157: note = Description of Unknown:uncultivated organism with predicted taxonomy: CandidatusSulfotelmatomonas gaucii
  REGION 1..157: note = MG4-166 HNH domain

SEQ ID NO: 4220 - protein, 165 aa, unidentified; identical to SEQ ID NO: 4185
  REGION 1..165: note = Description of Unknown:uncultivated organism with predicted taxonomy:Acidobacteriales bacterium 59-55
  REGION 1..165: note = MG4-167 HNH domain

SEQ ID NO: 4221 - protein, 160 aa, unidentified; identical to SEQ ID NO: 4179
  REGION 1..160: note = Description of Unknown:uncultivated organism
  REGION 1..160: note = MG4-168 HNH domain

SEQ ID NO: 4222 - protein, 157 aa, unidentified; identical to SEQ ID NO: 4170
  REGION 1..157: note = Description of Unknown:uncultivated organism
  REGION 1..157: note = MG4-169 HNH domain

SEQ ID NO: 4223 - protein, 160 aa, unidentified; identical to SEQ ID NO: 4179
  REGION 1..160: note = Description of Unknown:uncultivated organism
  REGION 1..160: note = MG4-170 HNH domain

SEQ ID NO: 4224 - protein, 157 aa, unidentified; identical to SEQ ID NO: 4170
  REGION 1..157: note = Description of Unknown:uncultivated organism
  REGION 1..157: note = MG4-171 HNH domain

SEQ ID NO: 4225 - protein, 157 aa, unidentified; identical to SEQ ID NO: 4170
  REGION 1..157: note = Description of Unknown:uncultivated organism
  REGION 1..157: note = MG4-172 HNH domain

SEQ ID NO: 4226 - protein, 167 aa, unidentified
  REGION 1..167: note = Description of Unknown:uncultivated organism with predicted taxonomy:Ignavibacteriales bacterium CG_4_9_14_3_um_filter_30_11
  REGION 1..167: note = MG4-173 HNH domain
DLKKSKKERQKQTEINRDREKLRQEATGELRKHDVVRFANPRNSDIEKYLLATEARWQCPYTSKKYGVTDVFGDHPQVDVEHIIPRSRSLDDSYLNKTLAYRSANMEKGNRTPREWLFESDQEQYDRMIGVVSGFDPRFEVGKKLRRFSMELSDPDSLLKEFTERQL

SEQ ID NO: 4227 - protein, 160 aa, unidentified; identical to SEQ ID NO: 4191
  REGION 1..160: note = Description of Unknown:uncultivated organism with predicted taxonomy: unculturedbacterium
  REGION 1..160: note = MG4-174 HNH domain

SEQ ID NO: 4228 - protein, 160 aa, unidentified; identical to SEQ ID NO: 4179
  REGION 1..160: note = Description of Unknown:uncultivated organism
  REGION 1..160: note = MG4-175 HNH domain

SEQ ID NO: 4229 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-176 HNH domain

SEQ ID NO: 4230 - protein, 168 aa, unidentified; identical to SEQ ID NO: 4193
  REGION 1..168: note = Description of Unknown:uncultivated organism
  REGION 1..168: note = MG4-177 HNH domain

SEQ ID NO: 4231 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-178 HNH domain

SEQ ID NO: 4232 - protein, 160 aa, unidentified; identical to SEQ ID NO: 4182
  REGION 1..160: note = Description of Unknown:uncultivated organism with predicted taxonomy: Acidobacteria
  REGION 1..160: note = MG4-179 HNH domain

SEQ ID NO: 4233 - protein, 157 aa, unidentified; identical to SEQ ID NO: 4175
  REGION 1..157: note = Description of Unknown:uncultivated organism
  REGION 1..157: note = MG4-180 HNH domain

SEQ ID NO: 4234 - protein, 160 aa, unidentified; identical to SEQ ID NO: 4179
  REGION 1..160: note = Description of Unknown:uncultivated organism
  REGION 1..160: note = MG4-181 HNH domain

SEQ ID NO: 4235 - protein, 157 aa, unidentified; identical to SEQ ID NO: 4170
  REGION 1..157: note = Description of Unknown:uncultivated organism
  REGION 1..157: note = MG4-182 HNH domain

SEQ ID NO: 4236 - protein, 160 aa, unidentified; identical to SEQ ID NO: 4191
  REGION 1..160: note = Description of Unknown:uncultivated organism
  REGION 1..160: note = MG4-183 HNH domain

SEQ ID NO: 4237 - protein, 157 aa, unidentified; identical to SEQ ID NO: 4175
  REGION 1..157: note = Description of Unknown:uncultivated organism
  REGION 1..157: note = MG4-184 HNH domain

SEQ ID NO: 4238 - protein, 157 aa, unidentified; identical to SEQ ID NO: 4170
  REGION 1..157: note = Description of Unknown:uncultivated organism
  REGION 1..157: note = MG4-185 HNH domain

SEQ ID NO: 4239 - protein, 160 aa, unidentified; identical to SEQ ID NO: 4179
  REGION 1..160: note = Description of Unknown:uncultivated organism
  REGION 1..160: note = MG4-186 HNH domain

SEQ ID NO: 4240 - protein, 160 aa, unidentified; identical to SEQ ID NO: 4182
  REGION 1..160: note = Description of Unknown:uncultivated organism with predicted taxonomy: Polaribactersp. ALD11
  REGION 1..160: note = MG4-187 HNH domain

SEQ ID NO: 4241 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-188 HNH domain

SEQ ID NO: 4242 - protein, 160 aa, unidentified; identical to SEQ ID NO: 4182
  REGION 1..160: note = Description of Unknown:uncultivated organism with predicted taxonomy: Polaribactersp. ALD11
  REGION 1..160: note = MG4-189 HNH domain

SEQ ID NO: 4243 - protein, 157 aa, unidentified; identical to SEQ ID NO: 4175
  REGION 1..157: note = Description of Unknown:uncultivated organism
  REGION 1..157: note = MG4-190 HNH domain

SEQ ID NO: 4244 - protein, 160 aa, unidentified; identical to SEQ ID NO: 4179
  REGION 1..160: note = Description of Unknown:uncultivated organism
  REGION 1..160: note = MG4-191 HNH domain

SEQ ID NO: 4245 - protein, 157 aa, unidentified; identical to SEQ ID NO: 4170
  REGION 1..157: note = Description of Unknown:uncultivated organism
  REGION 1..157: note = MG4-192 HNH domain

SEQ ID NO: 4246 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-193 HNH domain

SEQ ID NO: 4247 - protein, 160 aa, unidentified; identical to SEQ ID NO: 4179
  REGION 1..160: note = Description of Unknown:uncultivated organism
  REGION 1..160: note = MG4-194 HNH domain

SEQ ID NO: 4248 - protein, 157 aa, unidentified; identical to SEQ ID NO: 4170
  REGION 1..157: note = Description of Unknown:uncultivated organism
  REGION 1..157: note = MG4-195 HNH domain

SEQ ID NO: 4249 - protein, 160 aa, unidentified; identical to SEQ ID NO: 4182
  REGION 1..160: note = Description of Unknown:uncultivated organism with predicted taxonomy:Acidobacteriales bacterium 59-55
  REGION 1..160: note = MG4-196 HNH domain

SEQ ID NO: 4250 - protein, 157 aa, unidentified; identical to SEQ ID NO: 4170
  REGION 1..157: note = Description of Unknown:uncultivated organism
  REGION 1..157: note = MG4-197 HNH domain

SEQ ID NO: 4251 - protein, 163 aa, unidentified; identical to SEQ ID NO: 4209
  REGION 1..163: note = Description of Unknown:uncultivated organism
  REGION 1..163: note = MG4-198 HNH domain

SEQ ID NO: 4252 - protein, 160 aa, unidentified; identical to SEQ ID NO: 4179
  REGION 1..160: note = Description of Unknown:uncultivated organism
  REGION 1..160: note = MG4-199 HNH domain

SEQ ID NO: 4253 - protein, 160 aa, unidentified; identical to SEQ ID NO: 4179
  REGION 1..160: note = Description of Unknown:uncultivated organism
  REGION 1..160: note = MG4-200 HNH domain

SEQ ID NO: 4254 - protein, 160 aa, unidentified; identical to SEQ ID NO: 4182
  REGION 1..160: note = Description of Unknown:uncultivated organism with predicted taxonomy:Acidobacteriales bacterium 59-55
  REGION 1..160: note = MG4-201 HNH domain

SEQ ID NO: 4255 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-202 HNH domain

SEQ ID NO: 4256 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-203 HNH domain

SEQ ID NO: 4257 - protein, 157 aa, unidentified; identical to SEQ ID NO: 4170
  REGION 1..157: note = Description of Unknown:uncultivated organism with predicted taxonomy:Acidobacteriales bacterium 59-55
  REGION 1..157: note = MG4-204 HNH domain

SEQ ID NO: 4258 - protein, 167 aa, unidentified
  REGION 1..167: note = Description of Unknown:uncultivated organism with predicted taxonomy: Acidobacteria
  REGION 1..167: note = MG4-205 HNH domain
DLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQL

SEQ ID NO: 4259 - protein, 157 aa, unidentified; identical to SEQ ID NO: 4170
  REGION 1..157: note = Description of Unknown:uncultivated organism
  REGION 1..157: note = MG4-206 HNH domain

SEQ ID NO: 4260 - protein, 167 aa, unidentified; identical to SEQ ID NO: 4258
  REGION 1..167: note = Description of Unknown:uncultivated organism
  REGION 1..167: note = MG4-207 HNH domain

SEQ ID NO: 4261 - protein, 157 aa, unidentified; identical to SEQ ID NO: 4175
  REGION 1..157: note = Description of Unknown:uncultivated organism
  REGION 1..157: note = MG4-208 HNH domain

SEQ ID NO: 4262 - protein, 160 aa, unidentified; identical to SEQ ID NO: 4179
  REGION 1..160: note = Description of Unknown:uncultivated organism
  REGION 1..160: note = MG4-209 HNH domain

SEQ ID NO: 4263 - protein, 168 aa, unidentified; identical to SEQ ID NO: 4193
  REGION 1..168: note = Description of Unknown:uncultivated organism with predicted taxonomy: candidatedivision Kazan bacterium
  REGION 1..168: note = MG4-210 HNH domain

SEQ ID NO: 4264 - protein, 160 aa, unidentified; identical to SEQ ID NO: 4182
  REGION 1..160: note = Description of Unknown:uncultivated organism with predicted taxonomy:Acidobacteriales bacterium 59-55
  REGION 1..160: note = MG4-211 HNH domain

SEQ ID NO: 4265 - protein, 157 aa, unidentified; identical to SEQ ID NO: 4175
  REGION 1..157: note = Description of Unknown:uncultivated organism
  REGION 1..157: note = MG4-212 HNH domain

SEQ ID NO: 4266 - protein, 160 aa, unidentified; identical to SEQ ID NO: 4182
  REGION 1..160: note = Description of Unknown:uncultivated organism with predicted taxonomy: Polaribactersp. ALD11
  REGION 1..160: note = MG4-213 HNH domain

SEQ ID NO: 4267 - protein, 160 aa, unidentified; identical to SEQ ID NO: 4179
  REGION 1..160: note = Description of Unknown:uncultivated organism
  REGION 1..160: note = MG4-214 HNH domain

SEQ ID NO: 4268 - protein, 168 aa, unidentified; identical to SEQ ID NO: 4193
  REGION 1..168: note = Description of Unknown:uncultivated organism
  REGION 1..168: note = MG4-215 HNH domain

SEQ ID NO: 4269 - protein, 157 aa, unidentified; identical to SEQ ID NO: 4170
  REGION 1..157: note = Description of Unknown:uncultivated organism
  REGION 1..157: note = MG4-216 HNH domain

SEQ ID NO: 4270 - protein, 162 aa, unidentified
  REGION 1..162: note = Description of Unknown:uncultivated organism with predicted taxonomy: candidatedivision Zixibacteria bacterium CG_4_9_14_3_um_filter_46_8
  REGION 1..162: note = MG4-217 HNH domain
DLKQSKDHRLRATKNARDNEESRKAAIRKILAETPVRSPGPDDILRAQLYEECNHECPYTGRKIAFAALFGDSPQFDIEHIIPFSRCLDDSFANKTLCYHEVNRHVKGNRTPLEAFGSTPEWERIVQSVRLFSGKAAEGKLRRFLMTEEEILKLQDFANSQL

SEQ ID NO: 4271 - protein, 161 aa, unidentified
  REGION 1..161: note = Description of Unknown:uncultivated organism with predicted taxonomy:Planctomicrobium piriforme
  REGION 1..161: note = MG4-218 HNH domain
DMRRSKKQRQESWLRMRQNERDRKRAAQKILAEMNNDSPSRQDKEKVLLAEECNWTCPYTGKCISMQSLLGPTPQFDIEHIIPFSRSLDDSFTNKTLCDIAENRDHKRNRTPFEAYAAEPDKWNAILGRVGRFRSNAREEKVRRFRQEEIEGIEDFAARQL

SEQ ID NO: 4272 - protein, 157 aa, unidentified; identical to SEQ ID NO: 4207
  REGION 1..157: note = Description of Unknown:uncultivated organism with predicted taxonomy: CandidatusSulfotelmatomonas gaucii
  REGION 1..157: note = MG4-219 HNH domain

SEQ ID NO: 4273 - protein, 162 aa, unidentified
  REGION 1..162: note = Description of Unknown:uncultivated organism with predicted taxonomy: Proteobacteria
  REGION 1..162: note = MG4-220 HNH domain
DLRKSRKEREANWKKNRDIEKSRKIMAERITAEAGITDPSREDIRKALLAKECGWVCPYTGRAISMRALVGPDAQFDIEHIIPFSQSLDNSFFNVTLCYHEENRNRKRNQTPYGAYGNEPEKFQEILDRVRRFDSDLADEKLKRFQLTDTADILKGFVDRQL

SEQ ID NO: 4274 - protein, 160 aa, unidentified; identical to SEQ ID NO: 4182
  REGION 1..160: note = Description of Unknown:uncultivated organism with predicted taxonomy:Acidobacteriales bacterium 59-55
  REGION 1..160: note = MG4-221 HNH domain

SEQ ID NO: 4275 - protein, 157 aa, unidentified; identical to SEQ ID NO: 4170
  REGION 1..157: note = Description of Unknown:uncultivated organism
  REGION 1..157: note = MG4-222 HNH domain

SEQ ID NO: 4276 - protein, 160 aa, unidentified; identical to SEQ ID NO: 4179
  REGION 1..160: note = Description of Unknown:uncultivated organism
  REGION 1..160: note = MG4-223 HNH domain

SEQ ID NO: 4277 - protein, 157 aa, unidentified; identical to SEQ ID NO: 4175
  REGION 1..157: note = Description of Unknown:uncultivated organism
  REGION 1..157: note = MG4-224 HNH domain

SEQ ID NO: 4278 - protein, 168 aa, unidentified; identical to SEQ ID NO: 4193
  REGION 1..168: note = Description of Unknown:uncultivated organism
  REGION 1..168: note = MG4-225 HNH domain

SEQ ID NO: 4279 - protein, 160 aa, unidentified; identical to SEQ ID NO: 4182
  REGION 1..160: note = Description of Unknown:uncultivated organism with predicted taxonomy: Polaribactersp. ALD11
  REGION 1..160: note = MG4-226 HNH domain

SEQ ID NO: 4280 - protein, 160 aa, unidentified; identical to SEQ ID NO: 4179
  REGION 1..160: note = Description of Unknown:uncultivated organism
  REGION 1..160: note = MG4-227 HNH domain

SEQ ID NO: 4281 - protein, 164 aa, unidentified
  REGION 1..164: note = Description of Unknown:uncultivated organism
  REGION 1..164: note = MG4-247 HNH domain
DLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQL

SEQ ID NO: 4282 - protein, 164 aa, unidentified; identical to SEQ ID NO: 4281
  REGION 1..164: note = Description of Unknown:uncultivated organism with predicted taxonomy: Planctomycetes
  REGION 1..164: note = MG4-248 HNH domain

SEQ ID NO: 4283 - protein, 163 aa, unidentified
  REGION 1..163: note = Description of Unknown:uncultivated organism with predicted taxonomy: Fuerstiamarisgermanicae
  REGION 1..163: note = MG4-249 HNH domain
ELKKPKKRRELISKRNDENRSERETARREITEETGDPYPGKTDIRKVLLRRECGDQCVYCGEQFSGSNFFSDDAPIEIDHIIPRSLHWDDSFLNLALCHAKCNREKGDNTPAQVFSDEVIEQIRDRIRRFSGNEKTKRERFRRFTLAGAELSAYLEEFSRRQL

SEQ ID NO: 4284 - protein, 163 aa, unidentified
  REGION 1..163: note = Description of Unknown:uncultivated organism
  REGION 1..163: note = MG4-250 HNH domain
EMKKPKWRRKQISKRNRENETGRKQAKEEIKRETQNPYPSPYDIRKLILYKECRGQCVYCGAQISRSNLFGDNSDSEVDHIIPFSRLQEDSFTHVVLCHARCNAEKGNRTPSEAFTGEEHERILDRVSRFDNDEATRKAKLRHFTLAGEELANYLNDFSSRQL

SEQ ID NO: 4285 - protein, 156 aa, unidentified
  REGION 1..156: note = Description of Unknown:uncultivated organism
  REGION 1..156: note = MG4-251 HNH domain
DLKSSNKERERRTFEIRKREKARAEIAERIAREAQIEKPSRNDILKVMLADECNFTCPYTGKNFSMKELLYGKDIQIEHIIPYSRSFDDSFRNKTLCFSSANAKKNNRTPFEAFSGAEYEEILQRVGKFKWPFAEDKKDLFKCEKVDSEEFLARNL

SEQ ID NO: 4286 - protein, 156 aa, unidentified
  REGION 1..156: note = Description of Unknown:uncultivated organism with predicted taxonomy: Bdellovibrioexovorus
  REGION 1..156: note = MG4-252 HNH domain
DLKNTNKEKERITKQNREKEKERVKIIQQIIKEVGIASPTRNDILKVQLAEECGFECPYTGKHFSMAQLFDGNTIQIEHIIPFSRSFDDSYRNKTLCMATENGRKNNRTPYEAYAKEEYKAILTRVSHFKGPFRESKLQIFETKEFSPDDFLQRNL

SEQ ID NO: 4287 - protein, 156 aa, unidentified; identical to SEQ ID NO: 4285
  REGION 1..156: note = Description of Unknown:uncultivated organism
  REGION 1..156: note = MG4-253 HNH domain

SEQ ID NO: 4288 - protein, 156 aa, unidentified
  REGION 1..156: note = Description of Unknown:uncultivated organism
  REGION 1..156: note = MG4-254 HNH domain
DLKSSAKERERRMWEMRQREKERTAIAGKIAEEAGIENPSRNDILKVMLAEECGYECPYTGKHFSMRDLLHGKDIHIEHIIPYSRSFDDSYRNKTLCLASANAAKNNRTPFEAFSGKEYQDILQRVARFRGPFAEAKLALFKLEKVEPEEFLERNL

SEQ ID NO: 4289 - protein, 156 aa, unidentified; identical to SEQ ID NO: 4285
  REGION 1..156: note = Description of Unknown:uncultivated organism
  REGION 1..156: note = MG4-255 HNH domain

SEQ ID NO: 4290 - protein, 156 aa, unidentified; identical to SEQ ID NO: 4285
  REGION 1..156: note = Description of Unknown:uncultivated organism
  REGION 1..156: note = MG4-256 HNH domain

SEQ ID NO: 4291 - protein, 161 aa, unidentified
  REGION 1..161: note = Description of Unknown:uncultivated organism with predicted taxonomy: Planctomycetes
  REGION 1..161: note = MG4-257 HNH domain
DIKRNREERQNINKKISERTKEREAARTRLQEDFNLADPKSSDIEKYLLWQESGPKCPYCGNPIAGEVLFSGATHIDHIIPRKVSLDNSFVNKVLCCSKCNNDKSDRTPHEAFNGDTQRWEKIAERVGAFRSEYRREKLRRVLMTKKEAQEFYTGFTDSQL

SEQ ID NO: 4292 - protein, 160 aa, unidentified
  REGION 1..160: note = Description of Unknown:uncultivated organism
  REGION 1..160: note = MG4-258 HNH domain
DLKRNAKQREMNWRRGRDRETVRTAAVKRILDEAHRPQPWKQDVDRVLLLEECRDLCVYCGQAISFQRLFDGDIDIDHILPRNRFPDDSFANRCLAHRACNQLKLGRTPYEAFGSDEELWPNIIARVKTWDNPDKLERFNLRDDGEFDPEREDSFAARRL

SEQ ID NO: 4293 - protein, 157 aa, unidentified
  REGION 1..157: note = Description of Unknown:uncultivated organism with predicted taxonomy: Acidobacteria
  REGION 1..157: note = MG4-259 HNH domain
ELRKSRKERENVTKRNRSRERERQQAKARILQECGLQNPSRADIEKALLFEECGGVCPYTGRTIEFSSLFRDSQFDVEHIIPLSRYPDDSFLNKTLCYHEENRSVKRGRTPWEAYGPDSERWDAILSRVQGFNNPAKLTRFKLRTEEELGEFTQRQM

SEQ ID NO: 4294 - protein, 161 aa, unidentified
  REGION 1..161: note = Description of Unknown:uncultivated organism with predicted taxonomy: Planctomycetesbacterium
  REGION 1..161: note = MG4-260 HNH domain
DLKKPRHERAEAITKNRNREKERVAAKTKLLQELGPGFEHPSRADVEKALLHEECGGVCPYTGRHIEFASLFGENPQFDVEHIIPFSRIPDDSFQNKTLCYHEENRLVKRNMTPFEVYKDPAQYEAILNRVRTWKKLNPGKQRRFELRTLEELEGFSARQL

SEQ ID NO: 4295 - protein, 157 aa, unidentified
  REGION 1..157: note = Description of Unknown:uncultivated organism
  REGION 1..157: note = MG4-261 HNH domain
DLKASNKEREQITKRNQQRERERNAIAERIIKETGLEKISRKDILKVMLADECDFTCPYSGKRFSMTELLNGGLVEVEHIIPFSRSFDDSFANKTLCVRELNAKKNNRTPFEAFGGSPQYSEMLTRVKYFKGHFAEHKLNLFKLAEIESSGFLERNL

SEQ ID NO: 4296 - protein, 154 aa, unidentified
  REGION 1..154: note = Description of Unknown:uncultivated organism with predicted taxonomy: Planctomycetes
  REGION 1..154: note = MG6-7 HNH domain
DVKGNAKEREELRIKMNRNEKENERARHELIHNMGITRPTRDDILKYKLWQECGRECPYTGRPISQQALFGEHPEFQIEHIIPYSRCLDDSFMNKTLCYVDENRRKGDQTPYEFYKNSDQYEHMLQRIRKLPYPKRQKFTQKEVSLDEFIKRQL

SEQ ID NO: 4297 - protein, 155 aa, unidentified
  REGION 1..155: note = Description of Unknown:uncultivated organism with predicted taxonomy: Planctomycetesbacterium
  REGION 1..155: note = MG6-8 HNH domain
DVKGSVKERDEIRVKQWKNEQENKRAEEELKLMGIRNPSFNDRLKYKLWEECGKECPYTGKPISQHQLFGEHPDIQIEHILPYSRTLDDSYMNKTLCYVNENRLKGNETPYEYYAENRVEQWEEILQRIKVLPYAKRRRFWQKEVVLDNFIQRQL

SEQ ID NO: 4298 - protein, 155 aa, unidentified
  REGION 1..155: note = Description of Unknown:uncultivated organism
  REGION 1..155: note = MG6-9 HNH domain
DVKGSLKEREEIQWKMRENEKRNEAARTRLIQDMDILNPSRDDVIKYKLWEECGKRCPYTGKVISLTDLFGSNPVFQVEHILPYSRSLDDSYMNKTLCCVNENRIKGNKTPYEFYSGDEEKYEQVKQQIKVLPWPKRRRFLQKEIKLDECIQREM

SEQ ID NO: 4299 - protein, 156 aa, unidentified
  REGION 1..156: note = Description of Unknown:uncultivated organism with predicted taxonomy: Planctomycetesbacterium
  REGION 1..156: note = MG6-10 HNH domain
DLKGSLRERKEIHFKQKENERENKRVRERLKNDFNHVSLNRDNIIKYKLWEECNGLCPYTGKKIPQYALFGENPEFQIEHILPYSRSLDDSYMNKTLCEVHENISVKGNQTPYEAYHHDEEKYEQIKQRIKVLPWPKRRKFLQKEIELDEAITREL

SEQ ID NO: 4300 - protein, 155 aa, unidentified; identical to SEQ ID NO: 4297
  REGION 1..155: note = Description of Unknown:uncultivated organism with predicted taxonomy: Planctomycetesbacterium
  REGION 1..155: note = MG6-11 HNH domain

SEQ ID NO: 4301 - protein, 155 aa, unidentified; identical to SEQ ID NO: 4298
  REGION 1..155: note = Description of Unknown:uncultivated organism
  REGION 1..155: note = MG6-12 HNH domain

SEQ ID NO: 4302 - protein, 156 aa, unidentified; identical to SEQ ID NO: 4299
  REGION 1..156: note = Description of Unknown:uncultivated organism with predicted taxonomy: Planctomycetesbacterium
  REGION 1..156: note = MG6-13 HNH domain

SEQ ID NO: 4303 - protein, 165 aa, unidentified
  REGION 1..165: note = Description of Unknown:uncultivated organism
  REGION 1..165: note = MG6-20 HNH domain
EIKGSLRQRAEIRDQQEASRKDREEIRTMLRDPIEFGKDNPSNDDILAYRLWEQQGHLSPYSGKTICQTDLRRFLNGEGVLEIDHILPYSKSWDNSQSNKCLCFSDENKNKKDFTPRQWLGDGTDAYTSMLQYVAGMKTTGMPFSKRRKFSQLEVDPEDCAKRQL

SEQ ID NO: 4304 - protein, 175 aa, unidentified
  REGION 1..175: note = Description of Unknown:uncultivated organism with predicted taxonomy: Arcicellaaurantiaca
  REGION 1..175: note = MG7-2 HNH domain
ELKQNIKQRERTERNNNKRQKARKDVVKEILKTFPDMKEKDVTNRMIQKYELFQETNGICVYTGTEMKLGAVLSGQGFDIEHIIPKSRRFDDSFMNKTLADSSTNRDKNDLTAYDFMRKKGMTSFEKFTEIIHKLHKDKKISDTKLDNLLTTLNPVWIAEQEAKALSTDFINRQL

SEQ ID NO: 4305 - protein, 175 aa, unidentified
  REGION 1..175: note = Description of Unknown:uncultivated organism with predicted taxonomy:Flavobacteriales
  REGION 1..175: note = MG7-5 HNH domain
ELKQNIKQRERTESNNNKRQKARKDVVKEILKTFPDMKEKEVTQRMIQKYELFQETNGICVYTGTEMKLGAVLAGQGYDIEHIIPKSRRFDDSFMNKTLADSSTNRDKNDLTAYDFMRNKGMTAFEKFTEIIHTLHKNKKISDAKLDNLLTTLNPVWIAEKEAKELSTDFISRQL

SEQ ID NO: 4306 - protein, 175 aa, unidentified
  REGION 1..175: note = Description of Unknown:uncultivated organism with predicted taxonomy: Arcicellaaurantiaca
  REGION 1..175: note = MG7-6 HNH domain
ELKQNIKQRERTESNNNKRQKARKDVVKEILKTFPDMKEKEVTQRMIQKYELFQETNGICIYTGTEMKLGAVLSGQGYDIEHIIPKSRRFDDSFMNKTLADSSTNRDKNDLTAYDFMRNKGTTAFEKFTEIIHKLHKDKKISDTKLDNLLTTLNPVWIAEQEAKALSTDFISRQL

SEQ ID NO: 4307 - protein, 167 aa, unidentified
  REGION 1..167: note = Description of Unknown:uncultivated organism
  REGION 1..167: note = MG7-9 HNH domain
ELKQSAQERKKTHELNQKRRRENERIKKDIADHLAIPPEKVTRAQIEKYRFYKEIDGISLYTGKRFSLADVLNGDTVDVEHIIPRTLRFDDSYHNKTLCERNINQEKGNMTACDYMRSRGAQEYEAYLERVKAFYEKNGREVRLKYKNLTTTQEDLLKDNEFLQRQL

SEQ ID NO: 4308 - protein, 169 aa, unidentified
  REGION 1..169: note = Description of Unknown:uncultivated organism with predicted taxonomy: Bacteroidetes
  REGION 1..169: note = MG7-10 HNH domain
ELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDGEFLQRQL

SEQ ID NO: 4309 - protein, 163 aa, unidentified
  REGION 1..163: note = Description of Unknown:uncultivated organism with predicted taxonomy: Bacteroidetes
  REGION 1..163: note = MG7-11 HNH domain
ELKQNAEERNKTFSRNKKEDAKHKDIIHRLMTECNFKKVSRRDIERYKLWEEFGYVSPYEPSKPISLSELFSGAYEVEHIIPKSRLFDDSFANKTICPRPINAAKDNQTAFDYMSGLGQQKLDEFTDFIQKHKTKKDGISQTKAKYLLCKGSEIPQDFINRQM

SEQ ID NO: 4310 - protein, 169 aa, unidentified
  REGION 1..169: note = Description of Unknown:uncultivated organism with predicted taxonomy: Bacteroidetes
  REGION 1..169: note = MG7-12 HNH domain
ELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDEEFLQRQL

SEQ ID NO: 4311 - protein, 153 aa, unidentified
  REGION 1..153: note = Description of Unknown:uncultivated organism with predicted taxonomy:Deltaproteobacteria bacterium
  REGION 1..153: note = MG7-13 HNH domain
ELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANREKGNRTAYEYMEQKGELEKFREHVMNTNYPFPKKKRLLSPEVPEDFIQRQL

SEQ ID NO: 4312 - protein, 153 aa, unidentified
  REGION 1..153: note = Description of Unknown:uncultivated organism with predicted taxonomy:Deltaproteobacteria bacterium
  REGION 1..153: note = MG7-14 HNH domain
ELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANKEKGNRTAYEYMEQKGELEKFREHVMNTNYPFPKKKRLLSPEVPEDFIQRQL

SEQ ID NO: 4313 - protein, 163 aa, unidentified
  REGION 1..163: note = Description of Unknown:uncultivated organism with predicted taxonomy: Collinsella
  REGION 1..163: note = MG14-1 HNH domain
ELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4314 - protein, 172 aa, unidentified
  REGION 1..172: note = Description of Unknown:uncultivated organism
  REGION 1..172: note = MG14-3 HNH domain
ELKHSAHEKRLINASKNKNEKVNAKARQDLIDYYHLPSDAHIKTGDFRKVKLYNEQGGKDPYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQL

SEQ ID NO: 4315 - protein, 165 aa, unidentified
  REGION 1..165: note = Description of Unknown:uncultivated organism with predicted taxonomy:Coriobacteriales
  REGION 1..165: note = MG14-4 HNH domain
ELRLPQCAKDDIAKANKKNEKNRERIAGQIAELRGCSVEEVTGKQIEKYRLWEEQECFDLYTGDSIDVMRLIQDDSYTQIDHILPFSRTGENSKNNKVLVLAKSNQDKREQTPYEWMHSGKPSAPSWSDFERRVQENQKLSRRKKNFLLEKDLDSKEGEFLARSF

SEQ ID NO: 4316 - protein, 165 aa, unidentified; identical to SEQ ID NO: 4315
  REGION 1..165: note = Description of Unknown:uncultivated organism with predicted taxonomy: Actinobacteria
  REGION 1..165: note = MG14-5 HNH domain

SEQ ID NO: 4317 - protein, 172 aa, unidentified
  REGION 1..172: note = Description of Unknown:uncultivated organism with predicted taxonomy: Collinsella
  REGION 1..172: note = MG14-6 HNH domain
ELKHSAHEKRLINASKNKNEKINAKARQDLIDYYHLPSDAHIKTGDFRKVKLYNEQGGKDAYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQL

SEQ ID NO: 4318 - protein, 163 aa, unidentified
  REGION 1..163: note = Description of Unknown:uncultivated organism with predicted taxonomy: Collinsella
  REGION 1..163: note = MG14-7 HNH domain
ELRLPQRAKDEIAKANKKNEKNRERIARQIAELRGCTADEVTGKQIEKYRLWEEQECFDLYTGAKIEVDRLISDGTYTQIDHILPFSRTGENSRNNKVLVLAKSNQDKREQTPYEWMSHDGAPSWDAFERRVQENQKLSRRKKNFLLEKDLGTKEGEFLARSF

SEQ ID NO: 4319 - protein, 165 aa, unidentified
  REGION 1..165: note = Description of Unknown:uncultivated organism with predicted taxonomy: Olsenella
  REGION 1..165: note = MG14-8 HNH domain
ELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMSSGEAGAPSWDSYRARVMAQVKNPRKRANYLNTDLGPETQAKFLARNL

SEQ ID NO: 4320 - protein, 165 aa, unidentified
  REGION 1..165: note = Description of Unknown:uncultivated organism with predicted taxonomy: Olsenella sp.KH3B4
  REGION 1..165: note = MG14-9 HNH domain
ELKMSNKEKSLVDKRNRENAAANKKWAEKAAGILGCTPEEVSGRVIRKLILREEQGEKDLYTGQPIDLERLVRDDRYCEIDHILPYSRTCDDSRTNKVLVLSKSNQDKRERTPYEWMTSGETGAPSWDEYHARIMATVKNPRKRANYLNTDLGPETQAKFLARNL

SEQ ID NO: 4321 - protein, 163 aa, unidentified
  REGION 1..163: note = Description of Unknown:uncultivated organism with predicted taxonomy: Collinsella
  REGION 1..163: note = MG14-10 HNH domain
ELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSF

SEQ ID NO: 4322 - protein, 172 aa, unidentified
  REGION 1..172: note = Description of Unknown:uncultivated organism with predicted taxonomy: Collinsella sp.AF20-14LB
  REGION 1..172: note = MG14-11 HNH domain
DLKHTKREKKLITSGNIYNRKVNEKAKDDIVEFLGLANADRVRGRDLEKVRLYNEQGGKDPYTGQGIDFGRMLTEKSYVEVDHVLPFSRSCDNSKTNKVLVLTKSNRDKANRTPYEWMTSGEPTAPNWDEFCIRMDVWASGKEPKHYYSSKLAKLKEDNFTNNIDSFISRNL

SEQ ID NO: 4323 - protein, 163 aa, unidentified
  REGION 1..163: note = Description of Unknown:uncultivated organism with predicted taxonomy: Collinsella
  REGION 1..163: note = MG14-12 HNH domain
ELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSF

SEQ ID NO: 4324 - protein, 163 aa, unidentified; identical to SEQ ID NO: 4323
  REGION 1..163: note = Description of Unknown:uncultivated organism with predicted taxonomy: Collinsella
  REGION 1..163: note = MG14-13 HNH domain

SEQ ID NO: 4325 - protein, 165 aa, unidentified
  REGION 1..165: note = Description of Unknown:uncultivated organism with predicted taxonomy: Olsenella
  REGION 1..165: note = MG14-14 HNH domain
ELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNL

SEQ ID NO: 4326 - protein, 163 aa, unidentified; identical to SEQ ID NO: 4323
  REGION 1..163: note = Description of Unknown:uncultivated organism with predicted taxonomy:Coriobacteriales
  REGION 1..163: note = MG14-15 HNH domain

SEQ ID NO: 4327 - protein, 172 aa, unidentified
  REGION 1..172: note = Description of Unknown:uncultivated organism with predicted taxonomy: Eggerthellales
  REGION 1..172: note = MG14-16 HNH domain
ELKRSKHEREVVAESNRARRELNEQAKRDIVEFLGLPDDHHVRGRDLDMVKLYREQGGKDPYTGAGIDFRRMLEEHGYAEIDHILPISRTCDDSQANKVLCLTKSNRDKSNRSPYEWMTSGEAAAPDWDEFCGRMDRWAKMCEPRRYVRKKLANLTCENLAEHAEDFIKRNL

SEQ ID NO: 4328 - protein, 163 aa, unidentified; identical to SEQ ID NO: 4323
  REGION 1..163: note = Description of Unknown:uncultivated organism with predicted taxonomy: Collinsella
  REGION 1..163: note = MG14-17 HNH domain

SEQ ID NO: 4329 - protein, 165 aa, unidentified
  REGION 1..165: note = Description of Unknown:uncultivated organism with predicted taxonomy: Olsenella
  REGION 1..165: note = MG14-18 HNH domain
DLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANYLNTDLGPETQAKFLARNL

SEQ ID NO: 4330 - protein, 163 aa, unidentified
  REGION 1..163: note = Description of Unknown:uncultivated organism with predicted taxonomy:Coriobacteriales
  REGION 1..163: note = MG14-19 HNH domain
ELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKNLDAKEGEFLARSF

SEQ ID NO: 4331 - protein, 163 aa, unidentified; identical to SEQ ID NO: 4323
  REGION 1..163: note = Description of Unknown:uncultivated organism with predicted taxonomy:Coriobacteriales
  REGION 1..163: note = MG14-20 HNH domain

SEQ ID NO: 4332 - protein, 165 aa, unidentified; identical to SEQ ID NO: 4325
  REGION 1..165: note = Description of Unknown:uncultivated organism with predicted taxonomy: Olsenella sp.KH3B4
  REGION 1..165: note = MG14-21 HNH domain

SEQ ID NO: 4333 - protein, 163 aa, unidentified; identical to SEQ ID NO: 4323
  REGION 1..163: note = Description of Unknown:uncultivated organism with predicted taxonomy: Collinsella
  REGION 1..163: note = MG14-22 HNH domain

SEQ ID NO: 4334 - protein, 163 aa, unidentified; identical to SEQ ID NO: 4323
  REGION 1..163: note = Description of Unknown:uncultivated organism with predicted taxonomy: Collinsella
  REGION 1..163: note = MG14-23 HNH domain

SEQ ID NO: 4335 - protein, 163 aa, unidentified
  REGION 1..163: note = Description of Unknown:uncultivated organism with predicted taxonomy: Collinsella
  REGION 1..163: note = MG14-24 HNH domain
ELRLPQRAKDDIAKAHKKNEKNRERIAGQIAELRGCNPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSF

SEQ ID NO: 4336 - protein, 165 aa, unidentified
  REGION 1..165: note = Description of Unknown:uncultivated organism with predicted taxonomy: Olsenella
  REGION 1..165: note = MG14-25 HNH domain
ELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNL

SEQ ID NO: 4337 - protein, 163 aa, unidentified; identical to SEQ ID NO: 4323
  REGION 1..163: note = Description of Unknown:uncultivated organism with predicted taxonomy: Coriobacteriia
  REGION 1..163: note = MG14-26 HNH domain

SEQ ID NO: 4338 - protein, 163 aa, unidentified; identical to SEQ ID NO: 4323
  REGION 1..163: note = Description of Unknown:uncultivated organism with predicted taxonomy: Collinsella
  REGION 1..163: note = MG14-27 HNH domain

SEQ ID NO: 4339 - protein, 172 aa, unidentified
  REGION 1..172: note = Description of Unknown:uncultivated organism with predicted taxonomy: Collinsella
  REGION 1..172: note = MG14-28 HNH domain
ELKHTKHEKKLVDDGNKYNKREKEKAADDIVEYLGLSSADQVRGRDIDKVRLYNEQGGKDLYTGQGIDFGRMLTEKGYVEIDHILPYSRSCDNSRTNKVLVLTKSNRDKANRTPYEWMTSGEPTAPNWDEFCIRMDVWASGKEPKHYYSSKLAKLKEDNFTNNIDSFISRNL

SEQ ID NO: 4340 - protein, 163 aa, unidentified; identical to SEQ ID NO: 4323
  REGION 1..163: note = Description of Unknown:uncultivated organism with predicted taxonomy:Coriobacteriales
  REGION 1..163: note = MG14-29 HNH domain

SEQ ID NO: 4341 - protein, 163 aa, unidentified; identical to SEQ ID NO: 4330
  REGION 1..163: note = Description of Unknown:uncultivated organism with predicted taxonomy: Collinsella
  REGION 1..163: note = MG14-30 HNH domain

SEQ ID NO: 4342 - protein, 161 aa, unidentified
  REGION 1..161: note = Description of Unknown:uncultivated organism with predicted taxonomy: Coriobacteriiabacterium
  REGION 1..161: note = MG14-31 HNH domain
ELKQSAKEKDAILKSNNKTNKSREVLRKKLAEELSCDEDAIPFKLLEKIELWNQQDGRDLYVDEPIQYERLISDDSYCEIDHILPYSRTCDDSRMNKILVLQKSNQNKRESTPFEWMSATGDWDNFKLRILRLAHYPQKKKQRLLNTDLAEKQPEFIARNL

SEQ ID NO: 4343 - protein, 165 aa, unidentified
  REGION 1..165: note = Description of Unknown:uncultivated organism with predicted taxonomy: Olsenella sp.KH3B4
  REGION 1..165: note = MG14-32 HNH domain
DLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNL

SEQ ID NO: 4344 - protein, 163 aa, unidentified; identical to SEQ ID NO: 4323
  REGION 1..163: note = Description of Unknown:uncultivated organism with predicted taxonomy: Collinsella
  REGION 1..163: note = MG14-33 HNH domain

SEQ ID NO: 4345 - protein, 165 aa, unidentified
  REGION 1..165: note = Description of Unknown:uncultivated organism with predicted taxonomy: Olsenella
  REGION 1..165: note = MG14-34 HNH domain
DLKMSNKEKKQVEKRNRENAASNKKWATTAAGILGCTPEEVPGRIIRKLILREEQGEKDLYTGDSIDLEHLVRDDRYCEIGHILPYSRTCDDSRANKVLVLSKSNQDKRERTPYEWMTSGETSAPSWDSYRARVMAQVKNPRKRANYLNTDLGPETQAKFLARNL

SEQ ID NO: 4346 - protein, 167 aa, unidentified
  REGION 1..167: note = Description of Unknown:uncultivated organism with predicted taxonomy: Olsenella sp.KH3B4
  REGION 1..167: note = MG14-35 HNH domain
DLKMSKREKDAVSKRQRQNEATNKKWAKTAAGILGCEPEEVPGKVIRKLAMREEQGEKDAYTNAPIDLERLVREDHYCEIDHILPYSRTSEDSRANKVLVLSKSNQDKRERTPYEWMTQDVGKPGVPNWDEYHARVVATVKHPRKRANLLNTDLGPETEAKFLARNL

SEQ ID NO: 4347 - protein, 163 aa, unidentified
  REGION 1..163: note = Description of Unknown:uncultivated organism with predicted taxonomy:Coriobacteriales
  REGION 1..163: note = MG14-36 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4348 - protein, 172 aa, unidentified
  REGION 1..172: note = Description of Unknown:uncultivated organism with predicted taxonomy: Coprococcuscomes
  REGION 1..172: note = MG14-37 HNH domain
DLKRSKHEKAIIAATNKANKDSNEQAKKDLVAFYGLPNDAHVSSADFEKMWLYREQFGQDPYTGKGINLERMLNERDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNL

SEQ ID NO: 4349 - protein, 163 aa, unidentified
  REGION 1..163: note = Description of Unknown:uncultivated organism with predicted taxonomy: Coriobacteriiabacterium
  REGION 1..163: note = MG14-38 HNH domain
ELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSF

SEQ ID NO: 4350 - protein, 163 aa, unidentified; identical to SEQ ID NO: 4347
  REGION 1..163: note = Description of Unknown:uncultivated organism with predicted taxonomy: Collinsella
  REGION 1..163: note = MG14-39 HNH domain

SEQ ID NO: 4351 - protein, 172 aa, unidentified
  REGION 1..172: note = Description of Unknown:uncultivated organism
  REGION 1..172: note = MG14-40 HNH domain
DLKRSKHEKAIIAATNKANKDSNEQVKKDLVAFYGLPNDAHVSSTDFEKMWLYREQFGQDPYTGKGINLERMLNDRDYVEIDHILPFSRSCDDSKSNKVLCLTKSNRDKANRTPYEWMTSGEPSAPDFGDFCGRMDAWAGKGKSAHYTKSKLSKLKNSTFGKEEQKFIDRNL

SEQ ID NO: 4352 - protein, 163 aa, unidentified
  REGION 1..163: note = Description of Unknown:uncultivated organism with predicted taxonomy: Collinsella
  REGION 1..163: note = MG14-41 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSF

SEQ ID NO: 4353 - protein, 163 aa, unidentified
  REGION 1..163: note = Description of Unknown:uncultivated organism with predicted taxonomy: Collinsella
  REGION 1..163: note = MG14-42 HNH domain
ELRLPQRAKDEIAKANKKNEKNRERIAGQIAELRGCTADEVTGKQIEKYRLWEEQECFDLYTGTKIEVDRLISDDTYTQIDHILPFSRTGENSRNNKVLVLAKSNQDKREQTPYEWMSHDGAPSWNAFERRVQENQKLSRRKKNFLLEKDLDTKEGEFLARSF

SEQ ID NO: 4354 - protein, 163 aa, unidentified
  REGION 1..163: note = Description of Unknown:uncultivated organism with predicted taxonomy: Collinsella
  REGION 1..163: note = MG14-43 HNH domain
ELRLPQRAKDEIAKANKKNEKNSERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4355 - protein, 163 aa, unidentified; identical to SEQ ID NO: 4352
  REGION 1..163: note = Description of Unknown:uncultivated organism with predicted taxonomy: Olsenellamediterranea
  REGION 1..163: note = MG14-44 HNH domain

SEQ ID NO: 4356 - protein, 163 aa, unidentified; identical to SEQ ID NO: 4352
  REGION 1..163: note = Description of Unknown:uncultivated organism with predicted taxonomy: Collinsella
  REGION 1..163: note = MG14-45 HNH domain

SEQ ID NO: 4357 - protein, 163 aa, unidentified; identical to SEQ ID NO: 4347
  REGION 1..163: note = Description of Unknown:uncultivated organism with predicted taxonomy: Collinsella
  REGION 1..163: note = MG14-46 HNH domain

SEQ ID NO: 4358 - protein, 172 aa, unidentified
  REGION 1..172: note = Description of Unknown:uncultivated organism with predicted taxonomy: Collinsella sp.AM13-34
  REGION 1..172: note = MG14-47 HNH domain
DLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNL

SEQ ID NO: 4359 - protein, 163 aa, unidentified; identical to SEQ ID NO: 4347
  REGION 1..163: note = Description of Unknown:uncultivated organism with predicted taxonomy: Collinsella
  REGION 1..163: note = MG14-48 HNH domain

SEQ ID NO: 4360 - protein, 172 aa, unidentified
  REGION 1..172: note = Description of Unknown:uncultivated organism with predicted taxonomy: Collinsella sp.AF20-14LB
  REGION 1..172: note = MG14-49 HNH domain
DLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNL

SEQ ID NO: 4361 - protein, 165 aa, unidentified
  REGION 1..165: note = Description of Unknown:uncultivated organism with predicted taxonomy: Libanicoccusmassiliensis
  REGION 1..165: note = MG14-50 HNH domain
ELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTILDEDTQEGFINRNL

SEQ ID NO: 4362 - protein, 163 aa, unidentified
  REGION 1..163: note = Description of Unknown:uncultivated organism with predicted taxonomy: Collinsella
  REGION 1..163: note = MG14-51 HNH domain
ELRLPQRAKDEIAKANKKNEKNRERIAGQIAELRGCTADEVTGKQIEKYRLWEEQKCFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4363 - protein, 163 aa, unidentified
  REGION 1..163: note = Description of Unknown:uncultivated organism with predicted taxonomy: Collinsella
  REGION 1..163: note = MG14-52 HNH domain
ELRLPRRAKDEIAKANKKNEKNRERIARQIAELRGCTADEVTGKQIEKYRLWEEQECFDLYTGAKIEIGRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4364 - protein, 165 aa, unidentified
  REGION 1..165: note = Description of Unknown:uncultivated organism with predicted taxonomy: Olsenella sp.KH3B4
  REGION 1..165: note = MG14-53 HNH domain
DLKMSNKEKDLVDKRNRENEAAKKKWAKTAADILGIEPEEVPGRIVRKLIMREEQDNWDLYTGDAIDLERLVRDDRYCEIDHILPYSRTCDDSRANKVLVLSKSNQDKRERTPYEWMTSGEAGAPSWDEYRARVMALVKNPHKRANHLNTDLGEEAQAKFLARNL

SEQ ID NO: 4365 - protein, 165 aa, unidentified
  REGION 1..165: note = Description of Unknown:uncultivated organism with predicted taxonomy: Olsenella sp.KH3B4
  REGION 1..165: note = MG14-54 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNL

SEQ ID NO: 4366 - protein, 172 aa, unidentified
  REGION 1..172: note = Description of Unknown:uncultivated organism with predicted taxonomy: Collinsella
  REGION 1..172: note = MG14-55 HNH domain
DLKRTEHERKLITSGNIYNRRTNEKAKDDIVEYLGLSDADQVRGRDIDKVRLYNEQGGKDPYTGQGIDFGRMLTEKGYVEIDHILPFSRSCDNARTNKVLVLTKSNRNKSNRTPYEWMTSGEPTAPNWDEFCIRMDVWASGKEPKHYYSSKLAKLKEDNFTNNIDSFISRNL

SEQ ID NO: 4367 - protein, 163 aa, unidentified
  REGION 1..163: note = Description of Unknown:uncultivated organism with predicted taxonomy: Collinsella
  REGION 1..163: note = MG14-56 HNH domain
ELRLPRRAKDEIAKANKKNEKNRERIARQIAELRGCTADEVTGKQIEKYRLWEEQECFDLYTGAKIEVGRLISDDTYTQIDHILPFSRTGENSRNNKVLVLAKSNQDKREQTPYEWMSHDGAPSWDAFERRVQENQKLGRRKKNFLLEKDLDTKEGEFLARSF

SEQ ID NO: 4368 - protein, 165 aa, unidentified
  REGION 1..165: note = Description of Unknown:uncultivated organism with predicted taxonomy: Olsenella
  REGION 1..165: note = MG14-57 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNL

SEQ ID NO: 4369 - protein, 163 aa, unidentified; identical to SEQ ID NO: 4347
  REGION 1..163: note = Description of Unknown:uncultivated organism with predicted taxonomy: Collinsella
  REGION 1..163: note = MG14-58 HNH domain

SEQ ID NO: 4370 - protein, 163 aa, unidentified; identical to SEQ ID NO: 4349
  REGION 1..163: note = Description of Unknown:uncultivated organism with predicted taxonomy: Collinsella
  REGION 1..163: note = MG14-59 HNH domain

SEQ ID NO: 4371 - protein, 163 aa, unidentified; identical to SEQ ID NO: 4367
  REGION 1..163: note = Description of Unknown:uncultivated organism with predicted taxonomy: Collinsella
  REGION 1..163: note = MG14-60 HNH domain

SEQ ID NO: 4372 - protein, 163 aa, unidentified
  REGION 1..163: note = Description of Unknown:uncultivated organism with predicted taxonomy: Collinsella
  REGION 1..163: note = MG14-61 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSF

SEQ ID NO: 4373 - protein, 163 aa, unidentified; identical to SEQ ID NO: 4352
  REGION 1..163: note = Description of Unknown:uncultivated organism with predicted taxonomy: Collinsella
  REGION 1..163: note = MG14-62 HNH domain

SEQ ID NO: 4374 - protein, 172 aa, unidentified
  REGION 1..172: note = Description of Unknown:uncultivated organism with predicted taxonomy: Collinsella
  REGION 1..172: note = MG14-63 HNH domain
DLKRSKHEREIVAESNRARLELNEQAKRDIIEFLGLPDDHHVRGRDLALVKLYREQGGKDPYTGVGIDFRRMLEEHGYAEIDHILPVSRTCDDSQANKVLCLTKSNRDKSNRSPYEWMTSGEASAPDWNGFCGRMERWAKMCEPRRYARKKLANLTCENLAERAGNFIDRNL

SEQ ID NO: 4375 - protein, 163 aa, unidentified
  REGION 1..163: note = Description of Unknown:uncultivated organism with predicted taxonomy: Collinsella
  REGION 1..163: note = MG14-64 HNH domain
ELRLPQRAKDDIAKAHKRNEKNRERIAGQIAELRGCSPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEENLEAKEGEFLARSF

SEQ ID NO: 4376 - protein, 163 aa, unidentified; identical to SEQ ID NO: 4367
  REGION 1..163: note = Description of Unknown:uncultivated organism with predicted taxonomy: Collinsella
  REGION 1..163: note = MG14-65 HNH domain

SEQ ID NO: 4377 - protein, 163 aa, unidentified; identical to SEQ ID NO: 4347
  REGION 1..163: note = Description of Unknown:uncultivated organism with predicted taxonomy: Collinsella
  REGION 1..163: note = MG14-66 HNH domain

SEQ ID NO: 4378 - protein, 163 aa, unidentified; identical to SEQ ID NO: 4347
  REGION 1..163: note = Description of Unknown:uncultivated organism with predicted taxonomy: Collinsella
  REGION 1..163: note = MG14-67 HNH domain

SEQ ID NO: 4379 - protein, 163 aa, unidentified; identical to SEQ ID NO: 4347
  REGION 1..163: note = Description of Unknown:uncultivated organism with predicted taxonomy: Collinsella
  REGION 1..163: note = MG14-68 HNH domain

SEQ ID NO: 4380 - protein, 167 aa, unidentified
  REGION 1..167: note = Description of Unknown:uncultivated organism with predicted taxonomy: Olsenella
  REGION 1..167: note = MG14-69 HNH domain
DLKRSKHEKDLINKRNRENERKNKQWRAQIAEEQGIDPDEVRPKLLRKIALWEEQDNFDIYTGHKIEFDRMISDDKYCEIDHVLPYSRTCDDSRNNKVLVLAKSNQDKRERTPYEWMTQDARKGAPNWDEYQARVIANHHISPRKRRYLLDNNLGPDQESDFLSRNL

SEQ ID NO: 4381 - protein, 165 aa, unidentified
  REGION 1..165: note = Description of Unknown:uncultivated organism with predicted taxonomy: Collinsellatanakaei
  REGION 1..165: note = MG14-70 HNH domain
ELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNM

SEQ ID NO: 4382 - protein, 163 aa, unidentified; identical to SEQ ID NO: 4347
  REGION 1..163: note = Description of Unknown:uncultivated organism with predicted taxonomy: Collinsella
  REGION 1..163: note = MG14-71 HNH domain

SEQ ID NO: 4383 - protein, 171 aa, unidentified
  REGION 1..171: note = Description of Unknown:uncultivated organism with predicted taxonomy: Atopobium sp.ICM42b
  REGION 1..171: note = MG14-72 HNH domain
DIAKSAKEKSKIAKGQNENRKENERIKDKIAEILHIDQSEVTGKQITKMKLYEEQGGKDIYTGEGLGDIAFAGGRRFLIDDNYCEIDHVLPYSRSADDLKSNKVLVLAKSNQEKGNRTPYEWMNSNDGSHPNWEQFCLRVLSNVRLSDGKKSKLLEENFAEKEVSFIKRNM

SEQ ID NO: 4384 - protein, 163 aa, unidentified
  REGION 1..163: note = Description of Unknown:uncultivated organism with predicted taxonomy: Collinsella
  REGION 1..163: note = MG14-73 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDSKEGEFLARSF

SEQ ID NO: 4385 - protein, 172 aa, unidentified
  REGION 1..172: note = Description of Unknown:uncultivated organism with predicted taxonomy: Collinsella
  REGION 1..172: note = MG14-74 HNH domain
DLKRTEHEKKLITSGNIYNRRTNEKAKDDIVEYLGLSEADQVRGRDIDKVRLYNEQGGKDPYTGQGIDFGRMLTEKGYVEIDHILPFSRSCDNARTNKVLVLTKSNRDKSNRTPYEWMTSGEPTAPNWDEFCIRMDVWASGKEPKHYYSSKLAKLKEDNFTNNIDSFISRNL

SEQ ID NO: 4386 - protein, 172 aa, unidentified
  REGION 1..172: note = Description of Unknown:uncultivated organism with predicted taxonomy: Collinsella sp.AM13-34
  REGION 1..172: note = MG14-75 HNH domain
DLKRSKHEREIVAESNRARLELNEQAKRDIIEFLGLPDDHHVRGRDLALVKLYREQGGKDPYTGAGIDFRRMLEEHGYAEIDHILPVSRTCDDSQANKVLCLTKSNRDKSNRSPYEWMTSGEASAPDWGEFCGRMERWAKMCEPRRYARKKLANLTCENLTERAGNFIDRNL

SEQ ID NO: 4387 - protein, 163 aa, unidentified; identical to SEQ ID NO: 4347
  REGION 1..163: note = Description of Unknown:uncultivated organism with predicted taxonomy: Collinsella
  REGION 1..163: note = MG14-76 HNH domain

SEQ ID NO: 4388 - protein, 163 aa, unidentified
  REGION 1..163: note = Description of Unknown:uncultivated organism with predicted taxonomy: Collinsella
  REGION 1..163: note = MG14-77 HNH domain
ELRLPQRAKDEIAKTNKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4389 - protein, 163 aa, unidentified
  REGION 1..163: note = Description of Unknown:uncultivated organism with predicted taxonomy: Collinsella
  REGION 1..163: note = MG14-78 HNH domain
ELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSF

SEQ ID NO: 4390 - protein, 163 aa, unidentified; identical to SEQ ID NO: 4347
  REGION 1..163: note = Description of Unknown:uncultivated organism with predicted taxonomy: Collinsella
  REGION 1..163: note = MG14-79 HNH domain

SEQ ID NO: 4391 - protein, 163 aa, unidentified; identical to SEQ ID NO: 4313
  REGION 1..163: note = Description of Unknown:uncultivated organism with predicted taxonomy:Coriobacteriales
  REGION 1..163: note = MG14-80 HNH domain

SEQ ID NO: 4392 - protein, 163 aa, unidentified; identical to SEQ ID NO: 4389
  REGION 1..163: note = Description of Unknown:uncultivated organism with predicted taxonomy: Collinsella
  REGION 1..163: note = MG14-82 HNH domain

SEQ ID NO: 4393 - protein, 163 aa, unidentified; identical to SEQ ID NO: 4321
  REGION 1..163: note = Description of Unknown:uncultivated organism with predicted taxonomy: Collinsella
  REGION 1..163: note = MG14-83 HNH domain

SEQ ID NO: 4394 - protein, 165 aa, unidentified; identical to SEQ ID NO: 4325
  REGION 1..165: note = Description of Unknown:uncultivated organism with predicted taxonomy: Olsenella
  REGION 1..165: note = MG14-84 HNH domain

SEQ ID NO: 4395 - protein, 163 aa, unidentified; identical to SEQ ID NO: 4347
  REGION 1..163: note = Description of Unknown:uncultivated organism with predicted taxonomy: Collinsella
  REGION 1..163: note = MG14-85 HNH domain

SEQ ID NO: 4396 - protein, 163 aa, unidentified; identical to SEQ ID NO: 4352
  REGION 1..163: note = Description of Unknown:uncultivated organism with predicted taxonomy: Collinsella
  REGION 1..163: note = MG14-87 HNH domain

SEQ ID NO: 4397 - protein, 163 aa, unidentified; identical to SEQ ID NO: 4352
  REGION 1..163: note = Description of Unknown:uncultivated organism with predicted taxonomy: Collinsella
  REGION 1..163: note = MG14-88 HNH domain

SEQ ID NO: 4398 - protein, 163 aa, unidentified; identical to SEQ ID NO: 4347
  REGION 1..163: note = Description of Unknown:uncultivated organism with predicted taxonomy: Collinsella
  REGION 1..163: note = MG14-89 HNH domain

SEQ ID NO: 4399 - protein, 163 aa, unidentified
  REGION 1..163: note = Description of Unknown:uncultivated organism with predicted taxonomy: Coriobacteriia
  REGION 1..163: note = MG14-90 HNH domain
ELRLPQRAKDEIAKANKKNEENRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4400 - protein, 165 aa, unidentified; identical to SEQ ID NO: 4381
  REGION 1..165: note = Description of Unknown:uncultivated organism with predicted taxonomy: Collinsellatanakaei
  REGION 1..165: note = MG14-91 HNH domain

SEQ ID NO: 4401 - protein, 163 aa, unidentified; identical to SEQ ID NO: 4352
  REGION 1..163: note = Description of Unknown:uncultivated organism with predicted taxonomy: Collinsella
  REGION 1..163: note = MG14-92 HNH domain

SEQ ID NO: 4402 - protein, 163 aa, unidentified; identical to SEQ ID NO: 4352
  REGION 1..163: note = Description of Unknown:uncultivated organism with predicted taxonomy: Collinsella
  REGION 1..163: note = MG14-93 HNH domain

SEQ ID NO: 4403 - protein, 163 aa, unidentified; identical to SEQ ID NO: 4347
  REGION 1..163: note = Description of Unknown:uncultivated organism with predicted taxonomy: Collinsella
  REGION 1..163: note = MG14-94 HNH domain

SEQ ID NO: 4404 - protein, 172 aa, unidentified
  REGION 1..172: note = Description of Unknown:uncultivated organism with predicted taxonomy: Collinsella
  REGION 1..172: note = MG14-95 HNH domain
DLKRSKHEREIVAESNRARLELNEQAKRDIIEFLGLPDDHHVRGRDLALVKLYREQGGKDPYTGAGIDFRRMLEEHGYAEIDHILPVSRTCDDSQANKALCLTKSNRDKSNRSPYEWMTSGEASAPDWGEFCGRMERWAKMCETRRYARKKLANLTCENLAERAGNFIDRNL

SEQ ID NO: 4405 - protein, 163 aa, unidentified; identical to SEQ ID NO: 4347
  REGION 1..163: note = Description of Unknown:uncultivated organism with predicted taxonomy: Collinsella
  REGION 1..163: note = MG14-96 HNH domain

SEQ ID NO: 4406 - protein, 163 aa, unidentified; identical to SEQ ID NO: 4347
  REGION 1..163: note = Description of Unknown:uncultivated organism with predicted taxonomy: Collinsella
  REGION 1..163: note = MG14-97 HNH domain

SEQ ID NO: 4407 - protein, 163 aa, unidentified
  REGION 1..163: note = Description of Unknown:uncultivated organism with predicted taxonomy: Collinsella
  REGION 1..163: note = MG14-98 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDDAPSWDAFERRVQENQKLSRRKKNFLLEKDLDTKEGEFLARSF

SEQ ID NO: 4408 - protein, 165 aa, unidentified; identical to SEQ ID NO: 4320
  REGION 1..165: note = Description of Unknown:uncultivated organism with predicted taxonomy: Olsenella
  REGION 1..165: note = MG14-99 HNH domain

SEQ ID NO: 4409 - protein, 163 aa, unidentified; identical to SEQ ID NO: 4347
  REGION 1..163: note = Description of Unknown:uncultivated organism with predicted taxonomy: Collinsella
  REGION 1..163: note = MG14-100 HNH domain

SEQ ID NO: 4410 - protein, 172 aa, unidentified; identical to SEQ ID NO: 4358
  REGION 1..172: note = Description of Unknown:uncultivated organism with predicted taxonomy: Eggerthella sp.AM16-19
  REGION 1..172: note = MG14-101 HNH domain

SEQ ID NO: 4411 - protein, 165 aa, unidentified; identical to SEQ ID NO: 4365
  REGION 1..165: note = Description of Unknown:uncultivated organism with predicted taxonomy: Olsenella sp.KH3B4
  REGION 1..165: note = MG14-102 HNH domain

SEQ ID NO: 4412 - protein, 163 aa, unidentified
  REGION 1..163: note = Description of Unknown:uncultivated organism with predicted taxonomy: Collinsella
  REGION 1..163: note = MG14-103 HNH domain
ELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSF

SEQ ID NO: 4413 - protein, 163 aa, unidentified
  REGION 1..163: note = Description of Unknown:uncultivated organism with predicted taxonomy: Collinsella
  REGION 1..163: note = MG14-104 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDAKEGDFLARSF

SEQ ID NO: 4414 - protein, 163 aa, unidentified; identical to SEQ ID NO: 4330
  REGION 1..163: note = Description of Unknown:uncultivated organism with predicted taxonomy: Collinsella
  REGION 1..163: note = MG14-105 HNH domain

SEQ ID NO: 4415 - protein, 163 aa, unidentified; identical to SEQ ID NO: 4363
  REGION 1..163: note = Description of Unknown:uncultivated organism with predicted taxonomy: Collinsella
  REGION 1..163: note = MG14-106 HNH domain

SEQ ID NO: 4416 - protein, 163 aa, unidentified; identical to SEQ ID NO: 4313
  REGION 1..163: note = Description of Unknown:uncultivated organism with predicted taxonomy: Collinsella
  REGION 1..163: note = MG14-107 HNH domain

SEQ ID NO: 4417 - protein, 171 aa, unidentified
  REGION 1..171: note = Description of Unknown:uncultivated organism with predicted taxonomy: Atopobium sp.ICM42b
  REGION 1..171: note = MG14-108 HNH domain
DIAKSAKEKSKIAKGQNENRKENERIKDKIAKLLHIDQSEVTGKQITKMKLYEEQGGKDIYTGESLGDIAFAGGRRFLIDDNYCEIDHVLPYSRSADDLKSNKVLVLAKSNQEKGNRTPYEWMNSNDGNHPNWEQFCLRVTSNVRLSDSKKSKLLEENFAEKETSFIKRNM

SEQ ID NO: 4418 - protein, 171 aa, unidentified
  REGION 1..171: note = Description of Unknown:uncultivated organism with predicted taxonomy: Atopobium sp.ICM42b
  REGION 1..171: note = MG14-109 HNH domain
ELTKSPKQREKIAKEQNKNRKENERIRKEIAKYLEIDSSCVTKKQILKKKLYEEQKGLDVYTGESLEPSLHADDLTYLKDDSYCQIDHILPYSRSADDSIANKVLVLAKSNQDKGNRTPYEWMTSGHEHHLSWEEFAIRVSTNLSISDSKKWRLLEEDFNKKEVQFMNRNL

SEQ ID NO: 4419 - protein, 163 aa, unidentified; identical to SEQ ID NO: 4352
  REGION 1..163: note = Description of Unknown:uncultivated organism with predicted taxonomy: Collinsella
  REGION 1..163: note = MG14-110 HNH domain

SEQ ID NO: 4420 - protein, 172 aa, unidentified
  REGION 1..172: note = Description of Unknown:uncultivated organism
  REGION 1..172: note = MG14-111 HNH domain
DLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNL

SEQ ID NO: 4421 - protein, 163 aa, unidentified
  REGION 1..163: note = Description of Unknown:uncultivated organism with predicted taxonomy: Collinsella
  REGION 1..163: note = MG14-112 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSF

SEQ ID NO: 4422 - protein, 163 aa, unidentified; identical to SEQ ID NO: 4347
  REGION 1..163: note = Description of Unknown:uncultivated organism with predicted taxonomy: Collinsella
  REGION 1..163: note = MG14-113 HNH domain

SEQ ID NO: 4423 - protein, 163 aa, unidentified; identical to SEQ ID NO: 4347
  REGION 1..163: note = Description of Unknown:uncultivated organism with predicted taxonomy: Collinsella
  REGION 1..163: note = MG14-114 HNH domain

SEQ ID NO: 4424 - protein, 163 aa, unidentified; identical to SEQ ID NO: 4347
  REGION 1..163: note = Description of Unknown:uncultivated organism with predicted taxonomy: Collinsella
  REGION 1..163: note = MG14-115 HNH domain

SEQ ID NO: 4425 - protein, 163 aa, unidentified
  REGION 1..163: note = Description of Unknown:uncultivated organism with predicted taxonomy: Collinsella
  REGION 1..163: note = MG14-116 HNH domain
ELRLPQRAKDEIAKANKKNEKNRERIAGQIAELRGCAADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4426 - protein, 163 aa, unidentified; identical to SEQ ID NO: 4347
  REGION 1..163: note = Description of Unknown:uncultivated organism with predicted taxonomy: Collinsella
  REGION 1..163: note = MG14-117 HNH domain

SEQ ID NO: 4427 - protein, 165 aa, unidentified
  REGION 1..165: note = Description of Unknown:uncultivated organism with predicted taxonomy: Olsenella sp.KCTC 15699
  REGION 1..165: note = MG14-118 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNL

SEQ ID NO: 4428 - protein, 163 aa, unidentified; identical to SEQ ID NO: 4347
  REGION 1..163: note = Description of Unknown:uncultivated organism with predicted taxonomy: Collinsella
  REGION 1..163: note = MG14-119 HNH domain

SEQ ID NO: 4429 - protein, 165 aa, unidentified; identical to SEQ ID NO: 4381
  REGION 1..165: note = Description of Unknown:uncultivated organism with predicted taxonomy: Collinsellatanakaei
  REGION 1..165: note = MG14-120 HNH domain

SEQ ID NO: 4430 - protein, 163 aa, unidentified
  REGION 1..163: note = Description of Unknown:uncultivated organism with predicted taxonomy: Collinsella
  REGION 1..163: note = MG14-121 HNH domain
ELRLPQRAKDEIAKANKKNKKNRERIAGQIAELRGCTIDEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSF

SEQ ID NO: 4431 - protein, 165 aa, unidentified
  REGION 1..165: note = Description of Unknown:uncultivated organism with predicted taxonomy: Olsenella
  REGION 1..165: note = MG14-122 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANHLNTDLGPETQAKFLARNL

SEQ ID NO: 4432 - protein, 163 aa, unidentified; identical to SEQ ID NO: 4347
  REGION 1..163: note = Description of Unknown:uncultivated organism with predicted taxonomy: Olsenellamediterranea
  REGION 1..163: note = MG14-123 HNH domain

SEQ ID NO: 4433 - protein, 163 aa, unidentified; identical to SEQ ID NO: 4347
  REGION 1..163: note = Description of Unknown:uncultivated organism with predicted taxonomy: Collinsella
  REGION 1..163: note = MG14-124 HNH domain

SEQ ID NO: 4434 - protein, 163 aa, unidentified
  REGION 1..163: note = Description of Unknown:uncultivated organism with predicted taxonomy: Collinsella
  REGION 1..163: note = MG14-125 HNH domain
ELRLPQRAKVEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4435 - protein, 165 aa, unidentified
  REGION 1..165: note = Description of Unknown:uncultivated organism with predicted taxonomy: Libanicoccusmassiliensis
  REGION 1..165: note = MG14-126 HNH domain
ELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNL

SEQ ID NO: 4436 - protein, 163 aa, unidentified; identical to SEQ ID NO: 4347
  REGION 1..163: note = Description of Unknown:uncultivated organism with predicted taxonomy: Collinsella
  REGION 1..163: note = MG14-127 HNH domain

SEQ ID NO: 4437 - protein, 163 aa, unidentified; identical to SEQ ID NO: 4352
  REGION 1..163: note = Description of Unknown:uncultivated organism with predicted taxonomy: Collinsella
  REGION 1..163: note = MG14-128 HNH domain

SEQ ID NO: 4438 - protein, 163 aa, unidentified; identical to SEQ ID NO: 4434
  REGION 1..163: note = Description of Unknown:uncultivated organism with predicted taxonomy: Collinsella
  REGION 1..163: note = MG14-129 HNH domain

SEQ ID NO: 4439 - protein, 165 aa, unidentified; identical to SEQ ID NO: 4336
  REGION 1..165: note = Description of Unknown:uncultivated organism with predicted taxonomy: Olsenella sp.KH3B4
  REGION 1..165: note = MG14-130 HNH domain

SEQ ID NO: 4440 - protein, 163 aa, unidentified; identical to SEQ ID NO: 4352
  REGION 1..163: note = Description of Unknown:uncultivated organism with predicted taxonomy: Collinsella
  REGION 1..163: note = MG14-131 HNH domain

SEQ ID NO: 4441 - protein, 163 aa, unidentified
  REGION 1..163: note = Description of Unknown:uncultivated organism with predicted taxonomy: Collinsella
  REGION 1..163: note = MG14-132 HNH domain
ELRLPQRAKDEIAKANKKNEKNRERIAGQIAELRGCTADEVTGKQIEKYRLWEEQECFDLYTGAKIEVDRLINDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4442 - protein, 163 aa, unidentified; identical to SEQ ID NO: 4347
  REGION 1..163: note = Description of Unknown:uncultivated organism with predicted taxonomy: Collinsella
  REGION 1..163: note = MG14-133 HNH domain

SEQ ID NO: 4443 - protein, 163 aa, unidentified; identical to SEQ ID NO: 4347
  REGION 1..163: note = Description of Unknown:uncultivated organism with predicted taxonomy: Collinsella
  REGION 1..163: note = MG14-135 HNH domain

SEQ ID NO: 4444 - protein, 163 aa, unidentified; identical to SEQ ID NO: 4421
  REGION 1..163: note = Description of Unknown:uncultivated organism with predicted taxonomy: Collinsella
  REGION 1..163: note = MG14-136 HNH domain

SEQ ID NO: 4445 - protein, 172 aa, unidentified
  REGION 1..172: note = Description of Unknown:uncultivated organism with predicted taxonomy: Clostridiales
  REGION 1..172: note = MG14-137 HNH domain
DLKRSKREKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNL

SEQ ID NO: 4446 - protein, 163 aa, unidentified; identical to SEQ ID NO: 4313
  REGION 1..163: note = Description of Unknown:uncultivated organism with predicted taxonomy: Collinsella
  REGION 1..163: note = MG14-138 HNH domain

SEQ ID NO: 4447 - protein, 163 aa, unidentified; identical to SEQ ID NO: 4352
  REGION 1..163: note = Description of Unknown:uncultivated organism with predicted taxonomy: Collinsella
  REGION 1..163: note = MG14-139 HNH domain

SEQ ID NO: 4448 - protein, 163 aa, unidentified; identical to SEQ ID NO: 4313
  REGION 1..163: note = Description of Unknown:uncultivated organism with predicted taxonomy: Collinsella
  REGION 1..163: note = MG14-140 HNH domain

SEQ ID NO: 4449 - protein, 165 aa, unidentified; identical to SEQ ID NO: 4365
  REGION 1..165: note = Description of Unknown:uncultivated organism with predicted taxonomy: Olsenella sp.KH3B4
  REGION 1..165: note = MG14-141 HNH domain

SEQ ID NO: 4450 - protein, 163 aa, unidentified; identical to SEQ ID NO: 4352
  REGION 1..163: note = Description of Unknown:uncultivated organism with predicted taxonomy: Collinsella
  REGION 1..163: note = MG14-142 HNH domain

SEQ ID NO: 4451 - protein, 163 aa, unidentified; identical to SEQ ID NO: 4347
  REGION 1..163: note = Description of Unknown:uncultivated organism with predicted taxonomy: Collinsella
  REGION 1..163: note = MG14-143 HNH domain

SEQ ID NO: 4452 - protein, 172 aa, unidentified; identical to SEQ ID NO: 4358
  REGION 1..172: note = Description of Unknown:uncultivated organism with predicted taxonomy: Collinsella
  REGION 1..172: note = MG14-144 HNH domain

SEQ ID NO: 4453 - protein, 165 aa, unidentified; identical to SEQ ID NO: 4325
  REGION 1..165: note = Description of Unknown:uncultivated organism with predicted taxonomy: Olsenella sp.KCTC 15699
  REGION 1..165: note = MG14-145 HNH domain

SEQ ID NO: 4454 - protein, 165 aa, unidentified
  REGION 1..165: note = Description of Unknown:uncultivated organism with predicted taxonomy: Olsenella
  REGION 1..165: note = MG14-146 HNH domain
DLKMSNKEKSLVDKRNRENAASNKKWATTAAGILGCTPEEVPGRIIRKLILREEQGEKDLYTGDSIDLEHLVRDDRYCEIDHILPYSCTCDDSRANKVLVLSKSNQDKRERTPYEWMTSGEAGAPSWDSYRARVMAQVKNPRKRANYLNTDLGPETQAKFLARNL

SEQ ID NO: 4455 - protein, 167 aa, unidentified; identical to SEQ ID NO: 4346
  REGION 1..167: note = Description of Unknown:uncultivated organism with predicted taxonomy: Olsenella sp.KH3B4
  REGION 1..167: note = MG14-147 HNH domain

SEQ ID NO: 4456 - protein, 163 aa, unidentified; identical to SEQ ID NO: 4347
  REGION 1..163: note = Description of Unknown:uncultivated organism with predicted taxonomy: Olsenellamediterranea
  REGION 1..163: note = MG14-148 HNH domain

SEQ ID NO: 4457 - protein, 163 aa, unidentified; identical to SEQ ID NO: 4352
  REGION 1..163: note = Description of Unknown:uncultivated organism with predicted taxonomy: Collinsella
  REGION 1..163: note = MG14-149 HNH domain

SEQ ID NO: 4458 - protein, 163 aa, unidentified; identical to SEQ ID NO: 4347
  REGION 1..163: note = Description of Unknown:uncultivated organism with predicted taxonomy: Collinsella
  REGION 1..163: note = MG14-150 HNH domain

SEQ ID NO: 4459 - protein, 163 aa, unidentified; identical to SEQ ID NO: 4352
  REGION 1..163: note = Description of Unknown:uncultivated organism with predicted taxonomy: Collinsella
  REGION 1..163: note = MG14-151 HNH domain

SEQ ID NO: 4460 - protein, 163 aa, unidentified; identical to SEQ ID NO: 4323
  REGION 1..163: note = Description of Unknown:uncultivated organism with predicted taxonomy: Collinsella
  REGION 1..163: note = MG14-152 HNH domain

SEQ ID NO: 4461 - protein, 163 aa, unidentified; identical to SEQ ID NO: 4330
  REGION 1..163: note = Description of Unknown:uncultivated organism with predicted taxonomy:Coriobacteriales
  REGION 1..163: note = MG14-153 HNH domain

SEQ ID NO: 4462 - protein, 165 aa, unidentified; identical to SEQ ID NO: 4368
  REGION 1..165: note = Description of Unknown:uncultivated organism with predicted taxonomy: Olsenella
  REGION 1..165: note = MG14-154 HNH domain

SEQ ID NO: 4463 - protein, 165 aa, unidentified; identical to SEQ ID NO: 4345
  REGION 1..165: note = Description of Unknown:uncultivated organism with predicted taxonomy: Olsenella
  REGION 1..165: note = MG14-155 HNH domain

SEQ ID NO: 4464 - protein, 165 aa, unidentified; identical to SEQ ID NO: 4435
  REGION 1..165: note = Description of Unknown:uncultivated organism with predicted taxonomy: Libanicoccusmassiliensis
  REGION 1..165: note = MG14-156 HNH domain

SEQ ID NO: 4465 - protein, 163 aa, unidentified; identical to SEQ ID NO: 4347
  REGION 1..163: note = Description of Unknown:uncultivated organism with predicted taxonomy: Collinsella
  REGION 1..163: note = MG14-157 HNH domain

SEQ ID NO: 4466 - protein, 163 aa, unidentified; identical to SEQ ID NO: 4323
  REGION 1..163: note = Description of Unknown:uncultivated organism with predicted taxonomy: Collinsella
  REGION 1..163: note = MG14-158 HNH domain

SEQ ID NO: 4467 - protein, 163 aa, unidentified; identical to SEQ ID NO: 4347
  REGION 1..163: note = Description of Unknown:uncultivated organism with predicted taxonomy: Collinsella
  REGION 1..163: note = MG14-159 HNH domain

SEQ ID NO: 4468 - protein, 163 aa, unidentified; identical to SEQ ID NO: 4367
  REGION 1..163: note = Description of Unknown:uncultivated organism with predicted taxonomy: Collinsella
  REGION 1..163: note = MG14-160 HNH domain

SEQ ID NO: 4469 - protein, 163 aa, unidentified; identical to SEQ ID NO: 4367
  REGION 1..163: note = Description of Unknown:uncultivated organism with predicted taxonomy: Collinsella
  REGION 1..163: note = MG14-161 HNH domain

SEQ ID NO: 4470 - protein, 165 aa, unidentified; identical to SEQ ID NO: 4336
  REGION 1..165: note = Description of Unknown:uncultivated organism with predicted taxonomy: Olsenella
  REGION 1..165: note = MG14-162 HNH domain

SEQ ID NO: 4471 - protein, 163 aa, unidentified; identical to SEQ ID NO: 4367
  REGION 1..163: note = Description of Unknown:uncultivated organism with predicted taxonomy: Collinsella
  REGION 1..163: note = MG14-163 HNH domain

SEQ ID NO: 4472 - protein, 165 aa, unidentified; identical to SEQ ID NO: 4319
  REGION 1..165: note = Description of Unknown:uncultivated organism with predicted taxonomy: Olsenella
  REGION 1..165: note = MG14-164 HNH domain

SEQ ID NO: 4473 - protein, 163 aa, unidentified; identical to SEQ ID NO: 4323
  REGION 1..163: note = Description of Unknown:uncultivated organism with predicted taxonomy: Collinsella
  REGION 1..163: note = MG14-165 HNH domain

SEQ ID NO: 4474 - protein, 163 aa, unidentified; identical to SEQ ID NO: 4347
  REGION 1..163: note = Description of Unknown:uncultivated organism with predicted taxonomy: Collinsella sp.AM17-1
  REGION 1..163: note = MG14-166 HNH domain

SEQ ID NO: 4475 - protein, 163 aa, unidentified; identical to SEQ ID NO: 4352
  REGION 1..163: note = Description of Unknown:uncultivated organism with predicted taxonomy: Collinsella
  REGION 1..163: note = MG14-167 HNH domain

SEQ ID NO: 4476 - protein, 165 aa, unidentified; identical to SEQ ID NO: 4329
  REGION 1..165: note = Description of Unknown:uncultivated organism with predicted taxonomy: Olsenella sp.KH3B4
  REGION 1..165: note = MG14-168 HNH domain

SEQ ID NO: 4477 - protein, 165 aa, unidentified; identical to SEQ ID NO: 4325
  REGION 1..165: note = Description of Unknown:uncultivated organism with predicted taxonomy: Olsenella
  REGION 1..165: note = MG14-169 HNH domain

SEQ ID NO: 4478 - protein, 165 aa, unidentified; identical to SEQ ID NO: 4343
  REGION 1..165: note = Description of Unknown:uncultivated organism with predicted taxonomy: Olsenella sp.KH3B4
  REGION 1..165: note = MG14-170 HNH domain

SEQ ID NO: 4479 - protein, 161 aa, unidentified; identical to SEQ ID NO: 4342
  REGION 1..161: note = Description of Unknown:uncultivated organism with predicted taxonomy: Coriobacteriiabacterium
  REGION 1..161: note = MG14-171 HNH domain

SEQ ID NO: 4480 - protein, 163 aa, unidentified; identical to SEQ ID NO: 4375
  REGION 1..163: note = Description of Unknown:uncultivated organism with predicted taxonomy: Collinsella
  REGION 1..163: note = MG14-172 HNH domain

SEQ ID NO: 4481 - protein, 163 aa, unidentified; identical to SEQ ID NO: 4384
  REGION 1..163: note = Description of Unknown:uncultivated organism with predicted taxonomy: Collinsella
  REGION 1..163: note = MG14-173 HNH domain

SEQ ID NO: 4482 - protein, 163 aa, unidentified
  REGION 1..163: note = Description of Unknown:uncultivated organism with predicted taxonomy: Collinsella
  REGION 1..163: note = MG14-174 HNH domain
ELRLPQRAKDEIAKANKKNEKNRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4483 - protein, 163 aa, unidentified; identical to SEQ ID NO: 4349
  REGION 1..163: note = Description of Unknown:uncultivated organism with predicted taxonomy: Collinsella
  REGION 1..163: note = MG14-175 HNH domain

SEQ ID NO: 4484 - protein, 163 aa, unidentified; identical to SEQ ID NO: 4349
  REGION 1..163: note = Description of Unknown:uncultivated organism with predicted taxonomy: Collinsellaaerofaciens
  REGION 1..163: note = MG14-176 HNH domain

SEQ ID NO: 4485 - protein, 163 aa, unidentified; identical to SEQ ID NO: 4347
  REGION 1..163: note = Description of Unknown:uncultivated organism with predicted taxonomy: Collinsella
  REGION 1..163: note = MG14-177 HNH domain

SEQ ID NO: 4486 - protein, 165 aa, unidentified
  REGION 1..165: note = Description of Unknown:uncultivated organism with predicted taxonomy: Olsenella sp.GAM18
  REGION 1..165: note = MG14-178 HNH domain
DLKMSNKEKILVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNL

SEQ ID NO: 4487 - protein, 163 aa, unidentified; identical to SEQ ID NO: 4353
  REGION 1..163: note = Description of Unknown:uncultivated organism with predicted taxonomy: Collinsella
  REGION 1..163: note = MG14-179 HNH domain

SEQ ID NO: 4488 - protein, 163 aa, unidentified; identical to SEQ ID NO: 4347
  REGION 1..163: note = Description of Unknown:uncultivated organism with predicted taxonomy: Collinsella
  REGION 1..163: note = MG14-180 HNH domain

SEQ ID NO: 4489 - protein, 167 aa, unidentified; identical to SEQ ID NO: 4380
  REGION 1..167: note = Description of Unknown:uncultivated organism with predicted taxonomy: Olsenella
  REGION 1..167: note = MG14-181 HNH domain

SEQ ID NO: 4490 - protein, 163 aa, unidentified; identical to SEQ ID NO: 4347
  REGION 1..163: note = Description of Unknown:uncultivated organism with predicted taxonomy: Olsenellamediterranea
  REGION 1..163: note = MG14-182 HNH domain

SEQ ID NO: 4491 - protein, 163 aa, unidentified; identical to SEQ ID NO: 4347
  REGION 1..163: note = Description of Unknown:uncultivated organism with predicted taxonomy: Collinsella
  REGION 1..163: note = MG14-183 HNH domain

SEQ ID NO: 4492 - protein, 165 aa, unidentified; identical to SEQ ID NO: 4431
  REGION 1..165: note = Description of Unknown:uncultivated organism with predicted taxonomy: Olsenella
  REGION 1..165: note = MG14-184 HNH domain

SEQ ID NO: 4493 - protein, 163 aa, unidentified; identical to SEQ ID NO: 4347
  REGION 1..163: note = Description of Unknown:uncultivated organism with predicted taxonomy: Collinsella
  REGION 1..163: note = MG14-185 HNH domain

SEQ ID NO: 4494 - protein, 163 aa, unidentified; identical to SEQ ID NO: 4347
  REGION 1..163: note = Description of Unknown:uncultivated organism with predicted taxonomy: Collinsella
  REGION 1..163: note = MG14-186 HNH domain

SEQ ID NO: 4495 - protein, 163 aa, unidentified; identical to SEQ ID NO: 4399
  REGION 1..163: note = Description of Unknown:uncultivated organism with predicted taxonomy:Coriobacteriales
  REGION 1..163: note = MG14-187 HNH domain

SEQ ID NO: 4496 - protein, 163 aa, unidentified; identical to SEQ ID NO: 4441
  REGION 1..163: note = Description of Unknown:uncultivated organism with predicted taxonomy: Collinsella
  REGION 1..163: note = MG14-188 HNH domain

SEQ ID NO: 4497 - protein, 163 aa, unidentified; identical to SEQ ID NO: 4352
  REGION 1..163: note = Description of Unknown:uncultivated organism with predicted taxonomy: Collinsella
  REGION 1..163: note = MG14-189 HNH domain

SEQ ID NO: 4498 - protein, 163 aa, unidentified; identical to SEQ ID NO: 4347
  REGION 1..163: note = Description of Unknown:uncultivated organism with predicted taxonomy: Collinsella
  REGION 1..163: note = MG14-190 HNH domain

SEQ ID NO: 4499 - protein, 163 aa, unidentified; identical to SEQ ID NO: 4352
  REGION 1..163: note = Description of Unknown:uncultivated organism with predicted taxonomy: Collinsella
  REGION 1..163: note = MG14-191 HNH domain

SEQ ID NO: 4500 - protein, 163 aa, unidentified; identical to SEQ ID NO: 4347
  REGION 1..163: note = Description of Unknown:uncultivated organism with predicted taxonomy: Collinsella
  REGION 1..163: note = MG14-192 HNH domain

SEQ ID NO: 4501 - protein, 163 aa, unidentified; identical to SEQ ID NO: 4412
  REGION 1..163: note = Description of Unknown:uncultivated organism with predicted taxonomy: Collinsella
  REGION 1..163: note = MG14-193 HNH domain

SEQ ID NO: 4502 - protein, 165 aa, unidentified; identical to SEQ ID NO: 4364
  REGION 1..165: note = Description of Unknown:uncultivated organism with predicted taxonomy: Olsenella
  REGION 1..165: note = MG14-194 HNH domain

SEQ ID NO: 4503 - protein, 163 aa, unidentified; identical to SEQ ID NO: 4349
  REGION 1..163: note = Description of Unknown:uncultivated organism with predicted taxonomy: Collinsella
  REGION 1..163: note = MG14-195 HNH domain

SEQ ID NO: 4504 - protein, 172 aa, unidentified; identical to SEQ ID NO: 4374
  REGION 1..172: note = Description of Unknown:uncultivated organism with predicted taxonomy: Collinsella
  REGION 1..172: note = MG14-196 HNH domain

SEQ ID NO: 4505 - protein, 163 aa, unidentified; identical to SEQ ID NO: 4347
  REGION 1..163: note = Description of Unknown:uncultivated organism with predicted taxonomy: Collinsella
  REGION 1..163: note = MG14-197 HNH domain

SEQ ID NO: 4506 - protein, 163 aa, unidentified; identical to SEQ ID NO: 4347
  REGION 1..163: note = Description of Unknown:uncultivated organism with predicted taxonomy: Collinsella
  REGION 1..163: note = MG14-198 HNH domain

SEQ ID NO: 4507 - protein, 163 aa, unidentified; identical to SEQ ID NO: 4347
  REGION 1..163: note = Description of Unknown:uncultivated organism with predicted taxonomy: Collinsella
  REGION 1..163: note = MG14-199 HNH domain

SEQ ID NO: 4508 - protein, 163 aa, unidentified; identical to SEQ ID NO: 4352
  REGION 1..163: note = Description of Unknown:uncultivated organism with predicted taxonomy: Collinsella
  REGION 1..163: note = MG14-200 HNH domain

SEQ ID NO: 4509 - protein, 163 aa, unidentified; identical to SEQ ID NO: 4313
  REGION 1..163: note = Description of Unknown:uncultivated organism with predicted taxonomy: Collinsella
  REGION 1..163: note = MG14-201 HNH domain

SEQ ID NO: 4510 - protein, 163 aa, unidentified; identical to SEQ ID NO: 4434
  REGION 1..163: note = Description of Unknown:uncultivated organism with predicted taxonomy: Collinsella
  REGION 1..163: note = MG14-202 HNH domain

SEQ ID NO: 4511 - protein, 163 aa, unidentified; identical to SEQ ID NO: 4434
  REGION 1..163: note = Description of Unknown:uncultivated organism with predicted taxonomy: Collinsella
  REGION 1..163: note = MG14-203 HNH domain

SEQ ID NO: 4512 - protein, 163 aa, unidentified; identical to SEQ ID NO: 4352
  REGION 1..163: note = Description of Unknown:uncultivated organism with predicted taxonomy: Collinsella
  REGION 1..163: note = MG14-204 HNH domain

SEQ ID NO: 4513 - protein, 163 aa, unidentified
  REGION 1..163: note = Description of Unknown:uncultivated organism with predicted taxonomy: Olsenellamediterranea
  REGION 1..163: note = MG14-205 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDTKEGEFLARSF

SEQ ID NO: 4514 - protein, 163 aa, unidentified; identical to SEQ ID NO: 4347
  REGION 1..163: note = Description of Unknown:uncultivated organism with predicted taxonomy: Collinsella
  REGION 1..163: note = MG14-206 HNH domain

SEQ ID NO: 4515 - protein, 163 aa, unidentified; identical to SEQ ID NO: 4421
  REGION 1..163: note = Description of Unknown:uncultivated organism with predicted taxonomy: Collinsella
  REGION 1..163: note = MG14-207 HNH domain

SEQ ID NO: 4516 - protein, 165 aa, unidentified; identical to SEQ ID NO: 4365
  REGION 1..165: note = Description of Unknown:uncultivated organism with predicted taxonomy: Olsenella
  REGION 1..165: note = MG14-208 HNH domain

SEQ ID NO: 4517 - protein, 163 aa, unidentified; identical to SEQ ID NO: 4352
  REGION 1..163: note = Description of Unknown:uncultivated organism with predicted taxonomy: Collinsella
  REGION 1..163: note = MG14-209 HNH domain

SEQ ID NO: 4518 - protein, 163 aa, unidentified; identical to SEQ ID NO: 4389
  REGION 1..163: note = Description of Unknown:uncultivated organism with predicted taxonomy: Collinsella
  REGION 1..163: note = MG14-210 HNH domain

SEQ ID NO: 4519 - protein, 163 aa, unidentified; identical to SEQ ID NO: 4347
  REGION 1..163: note = Description of Unknown:uncultivated organism with predicted taxonomy: Collinsella
  REGION 1..163: note = MG14-211 HNH domain

SEQ ID NO: 4520 - protein, 172 aa, unidentified; identical to SEQ ID NO: 4404
  REGION 1..172: note = Description of Unknown:uncultivated organism with predicted taxonomy: Collinsella
  REGION 1..172: note = MG14-212 HNH domain

SEQ ID NO: 4521 - protein, 163 aa, unidentified; identical to SEQ ID NO: 4347
  REGION 1..163: note = Description of Unknown:uncultivated organism with predicted taxonomy: Collinsella
  REGION 1..163: note = MG14-213 HNH domain

SEQ ID NO: 4522 - protein, 163 aa, unidentified; identical to SEQ ID NO: 4347
  REGION 1..163: note = Description of Unknown:uncultivated organism with predicted taxonomy:Coriobacteriales
  REGION 1..163: note = MG14-214 HNH domain

SEQ ID NO: 4523 - protein, 167 aa, unidentified
  REGION 1..167: note = Description of Unknown:uncultivated organism with predicted taxonomy: Olsenella
  REGION 1..167: note = MG14-215 HNH domain
ELKQSKREKDAISKFQRKKEQANNRYREVAAGILNISPDEVSDRIIEKMAFREQQNDKDAYTGTTINLERLVTDSHYCQVDHVLPYSRTSDNSRNNRVLVLSTTNQNKRERTPFEWMNSGEANAPAWNDYKKHVLANKNYSQRKKQVYLLNENLDSETEAQFISRNL

SEQ ID NO: 4524 - protein, 163 aa, unidentified; identical to SEQ ID NO: 4347
  REGION 1..163: note = Description of Unknown:uncultivated organism with predicted taxonomy: Collinsella
  REGION 1..163: note = MG14-216 HNH domain

SEQ ID NO: 4525 - protein, 163 aa, unidentified; identical to SEQ ID NO: 4372
  REGION 1..163: note = Description of Unknown:uncultivated organism with predicted taxonomy: Collinsella
  REGION 1..163: note = MG14-217 HNH domain

SEQ ID NO: 4526 - protein, 163 aa, unidentified; identical to SEQ ID NO: 4347
  REGION 1..163: note = Description of Unknown:uncultivated organism with predicted taxonomy: Olsenellamediterranea
  REGION 1..163: note = MG14-218 HNH domain

SEQ ID NO: 4527 - protein, 163 aa, unidentified; identical to SEQ ID NO: 4352
  REGION 1..163: note = Description of Unknown:uncultivated organism with predicted taxonomy: Collinsella
  REGION 1..163: note = MG14-219 HNH domain

SEQ ID NO: 4528 - protein, 163 aa, unidentified; identical to SEQ ID NO: 4352
  REGION 1..163: note = Description of Unknown:uncultivated organism with predicted taxonomy: Collinsella
  REGION 1..163: note = MG14-220 HNH domain

SEQ ID NO: 4529 - protein, 163 aa, unidentified; identical to SEQ ID NO: 4347
  REGION 1..163: note = Description of Unknown:uncultivated organism with predicted taxonomy: Collinsella
  REGION 1..163: note = MG14-221 HNH domain

SEQ ID NO: 4530 - protein, 163 aa, unidentified; identical to SEQ ID NO: 4413
  REGION 1..163: note = Description of Unknown:uncultivated organism with predicted taxonomy: Collinsella
  REGION 1..163: note = MG14-222 HNH domain

SEQ ID NO: 4531 - protein, 172 aa, unidentified
  REGION 1..172: note = Description of Unknown:uncultivated organism with predicted taxonomy: Collinsella sp.AM13-34
  REGION 1..172: note = MG14-223 HNH domain
DLKRSKHEREIVAESNRARLELNEQAKRDIIEFLGLPDDHHVRGRDLALVKLYREQGGKDPYTGAAIDFRRMLEEHRYAEIDHILPVSRTCDDSQANKVLCLTKSNRDKSNRSPYEWMTSGEASAPDWGEFCGRMERWAKMCEPRRYARKKLANLTCENLAERAGNFIDRNL

SEQ ID NO: 4532 - protein, 163 aa, unidentified; identical to SEQ ID NO: 4347
  REGION 1..163: note = Description of Unknown:uncultivated organism with predicted taxonomy: Collinsella
  REGION 1..163: note = MG14-224 HNH domain

SEQ ID NO: 4533 - protein, 163 aa, unidentified; identical to SEQ ID NO: 4313
  REGION 1..163: note = Description of Unknown:uncultivated organism with predicted taxonomy: Collinsella
  REGION 1..163: note = MG14-225 HNH domain

SEQ ID NO: 4534 - protein, 163 aa, unidentified; identical to SEQ ID NO: 4313
  REGION 1..163: note = Description of Unknown:uncultivated organism with predicted taxonomy: Collinsella
  REGION 1..163: note = MG14-226 HNH domain

SEQ ID NO: 4535 - protein, 163 aa, unidentified; identical to SEQ ID NO: 4362
  REGION 1..163: note = Description of Unknown:uncultivated organism with predicted taxonomy: Collinsella
  REGION 1..163: note = MG14-227 HNH domain

SEQ ID NO: 4536 - protein, 165 aa, unidentified; identical to SEQ ID NO: 4381
  REGION 1..165: note = Description of Unknown:uncultivated organism with predicted taxonomy: Olsenella
  REGION 1..165: note = MG14-228 HNH domain

SEQ ID NO: 4537 - protein, 163 aa, unidentified; identical to SEQ ID NO: 4347
  REGION 1..163: note = Description of Unknown:uncultivated organism with predicted taxonomy: Olsenella
  REGION 1..163: note = MG14-229 HNH domain

SEQ ID NO: 4538 - protein, 163 aa, unidentified; identical to SEQ ID NO: 4347
  REGION 1..163: note = Description of Unknown:uncultivated organism with predicted taxonomy: Collinsella
  REGION 1..163: note = MG14-230 HNH domain

SEQ ID NO: 4539 - protein, 163 aa, unidentified; identical to SEQ ID NO: 4421
  REGION 1..163: note = Description of Unknown:uncultivated organism with predicted taxonomy: Collinsella
  REGION 1..163: note = MG14-231 HNH domain

SEQ ID NO: 4540 - protein, 163 aa, unidentified; identical to SEQ ID NO: 4352
  REGION 1..163: note = Description of Unknown:uncultivated organism with predicted taxonomy: Collinsella
  REGION 1..163: note = MG14-232 HNH domain

SEQ ID NO: 4541 - protein, 163 aa, unidentified; identical to SEQ ID NO: 4347
  REGION 1..163: note = Description of Unknown:uncultivated organism with predicted taxonomy: Collinsella
  REGION 1..163: note = MG14-233 HNH domain

SEQ ID NO: 4542 - protein, 163 aa, unidentified; identical to SEQ ID NO: 4352
  REGION 1..163: note = Description of Unknown:uncultivated organism with predicted taxonomy: Collinsella
  REGION 1..163: note = MG14-234 HNH domain

SEQ ID NO: 4543 - protein, 163 aa, unidentified; identical to SEQ ID NO: 4425
  REGION 1..163: note = Description of Unknown:uncultivated organism with predicted taxonomy: Collinsella
  REGION 1..163: note = MG14-235 HNH domain

SEQ ID NO: 4544 - protein, 163 aa, unidentified; identical to SEQ ID NO: 4347
  REGION 1..163: note = Description of Unknown:uncultivated organism with predicted taxonomy: Collinsella
  REGION 1..163: note = MG14-236 HNH domain

SEQ ID NO: 4545 - protein, 163 aa, unidentified; identical to SEQ ID NO: 4347
  REGION 1..163: note = Description of Unknown:uncultivated organism with predicted taxonomy: Collinsella
  REGION 1..163: note = MG14-237 HNH domain

SEQ ID NO: 4546 - protein, 171 aa, unidentified; identical to SEQ ID NO: 4417
  REGION 1..171: note = Description of Unknown:uncultivated organism with predicted taxonomy: Atopobium sp.ICM42b
  REGION 1..171: note = MG14-238 HNH domain

SEQ ID NO: 4547 - protein, 163 aa, unidentified; identical to SEQ ID NO: 4389
  REGION 1..163: note = Description of Unknown:uncultivated organism with predicted taxonomy: Collinsella
  REGION 1..163: note = MG14-239 HNH domain

SEQ ID NO: 4548 - protein, 163 aa, unidentified; identical to SEQ ID NO: 4407
  REGION 1..163: note = Description of Unknown:uncultivated organism with predicted taxonomy: Collinsella
  REGION 1..163: note = MG14-240 HNH domain

SEQ ID NO: 4549 - protein, 163 aa, unidentified; identical to SEQ ID NO: 4430
  REGION 1..163: note = Description of Unknown:uncultivated organism with predicted taxonomy: Collinsella
  REGION 1..163: note = MG14-241 HNH domain

SEQ ID NO: 4550 - protein, 163 aa, unidentified; identical to SEQ ID NO: 4388
  REGION 1..163: note = Description of Unknown:uncultivated organism with predicted taxonomy: Collinsella
  REGION 1..163: note = MG14-242 HNH domain

SEQ ID NO: 4551 - protein, 163 aa, unidentified; identical to SEQ ID NO: 4352
  REGION 1..163: note = Description of Unknown:uncultivated organism with predicted taxonomy: Collinsella
  REGION 1..163: note = MG14-243 HNH domain

SEQ ID NO: 4552 - protein, 167 aa, unidentified
  REGION 1..167: note = Description of Unknown:uncultivated organism
  REGION 1..167: note = MG14-244 HNH domain
DLKMSKREKDAVAKRQRTNEAANKKRATLAAGILGCEPSEVSHLVIRKLALREEQSDKDIYTGAAIDLQRLVEDDHYCEIGHILPYSRTGMGGWNNEVLVLAASNQKKRERTPYEWMQQDAGKAGVPAWDEYSSRVTATIDNPRKRRNLLCKDTGDEAMNGFLLRDL

SEQ ID NO: 4553 - protein, 165 aa, unidentified
  REGION 1..165: note = Description of Unknown:uncultivated organism with predicted taxonomy: Olsenella
  REGION 1..165: note = MG14-245 HNH domain
DLKMSNKEKATVSKNQRANEAANKKWAAKAANILGCSPEEVPGRIVRKLAMREEQGDKDAYTGAAIDLEHLVRDDRYCEIDHILPYSRTCDDSRANKVLVLSKSNQDKRERTPYEWMTSGEPGAPDWDEYRNRVMATVKYARKRANLLNTDLGPNVQAQFLARNL

SEQ ID NO: 4554 - protein, 166 aa, unidentified
  REGION 1..166: note = Description of Unknown:uncultivated organism with predicted taxonomy:Coriobacteriales
  REGION 1..166: note = MG14-246 HNH domain
ELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNL

SEQ ID NO: 4555 - protein, 166 aa, unidentified; identical to SEQ ID NO: 4554
  REGION 1..166: note = Description of Unknown:uncultivated organism with predicted taxonomy:Coriobacteriales
  REGION 1..166: note = MG14-247 HNH domain

SEQ ID NO: 4556 - protein, 166 aa, unidentified; identical to SEQ ID NO: 4554
  REGION 1..166: note = Description of Unknown:uncultivated organism
  REGION 1..166: note = MG14-248 HNH domain

SEQ ID NO: 4557 - protein, 166 aa, unidentified; identical to SEQ ID NO: 4554
  REGION 1..166: note = Description of Unknown:uncultivated organism with predicted taxonomy: Olsenella
  REGION 1..166: note = MG14-249 HNH domain

SEQ ID NO: 4558 - protein, 167 aa, unidentified
  REGION 1..167: note = Description of Unknown:uncultivated organism with predicted taxonomy: Olsenella
  REGION 1..167: note = MG14-250 HNH domain
ELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNL

SEQ ID NO: 4559 - protein, 167 aa, unidentified
  REGION 1..167: note = Description of Unknown:uncultivated organism
  REGION 1..167: note = MG14-251 HNH domain
NLKMSKREKDAIAKRQRSNEAANKKWAALAAGILDCEPSEVPHLVIRKLALREEQGDKDVYTGAAIDLERLVADDHYCEIDHILPYSRTGMSGWNNEVLVLAASNQKKRERTPYEWMQQDAGKSGVPAWDAYSSRVAATIGNPRKRRNLLCMDTGQEAMNGFLLRDL

SEQ ID NO: 4560 - protein, 167 aa, unidentified
  REGION 1..167: note = Description of Unknown:uncultivated organism with predicted taxonomy: Olsenellaumbonata
  REGION 1..167: note = MG14-252 HNH domain
DLKRSKHEKDLISKRNRENERKNKQWRAQAAEIQGIDPDEVRPKLLKKMALWEEQGGLDAYTGHKIEFDRMISDDKYCEIDHVLPYSRTCDDSRSNKVLVLAKSNQDKRERTPYEWMTQDAQKGAPSWDEYQARVIANRHISPRKRRYLLNNNLGPDQESDFLNRNL

SEQ ID NO: 4561 - protein, 164 aa, unidentified
  REGION 1..164: note = Description of Unknown:uncultivated organism with predicted taxonomy: Atopobium sp.ICM42b
  REGION 1..164: note = MG14-253 HNH domain
DLKNSKAARDMIAKRQRDREKEKNALRKVIAELLSCELEDVTSNQLFRYELRQEQGDVDVYTGEQIDLMRMLLDQSYTQIDHILPYSRTAIDSRSNKVLVLSGSNAAKGERTPLEWMEEDVGAPDKDQYQSRIHSMSLPAAKKEKLLRRELTDADSRGFLDRNL

SEQ ID NO: 4562 - protein, 167 aa, unidentified; identical to SEQ ID NO: 4558
  REGION 1..167: note = Description of Unknown:uncultivated organism with predicted taxonomy: Olsenella sp.KH3B4
  REGION 1..167: note = MG14-254 HNH domain

SEQ ID NO: 4563 - protein, 167 aa, unidentified; identical to SEQ ID NO: 4560
  REGION 1..167: note = Description of Unknown:uncultivated organism with predicted taxonomy: Olsenella
  REGION 1..167: note = MG14-255 HNH domain

SEQ ID NO: 4564 - protein, 164 aa, unidentified
  REGION 1..164: note = Description of Unknown:uncultivated organism with predicted taxonomy: Olsenella
  REGION 1..164: note = MG14-256 HNH domain
DLKNSKAVKDKISNQQRRREAEKATLRRTIAELLQCEPDDVTGGQLLRYELRQEQNDQDVYTGDSIDLMRMLRDQSYTQIDHILPYSRTAIDSRSNKVLVLASSNAAKGERTPLEWMEQDANGPSIDAYQSRVHALNLPSAKKEKLLRRELTEDDAKHFLDRNL

SEQ ID NO: 4565 - protein, 160 aa, unidentified
  REGION 1..160: note = Description of Unknown:uncultivated organism with predicted taxonomy: Megasphaera
  REGION 1..160: note = MG15-1 HNH domain
ELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4566 - protein, 159 aa, unidentified
  REGION 1..159: note = Description of Unknown:uncultivated organism with predicted taxonomy: Selenomonas sp.AE3005
  REGION 1..159: note = MG15-3 HNH domain
EMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHL

SEQ ID NO: 4567 - protein, 159 aa, unidentified; identical to SEQ ID NO: 4566
  REGION 1..159: note = Description of Unknown:uncultivated organism with predicted taxonomy: Selenomonas sp.AE3005
  REGION 1..159: note = MG15-4 HNH domain

SEQ ID NO: 4568 - protein, 160 aa, unidentified
  REGION 1..160: note = Description of Unknown:uncultivated organism with predicted taxonomy: Veillonellales
  REGION 1..160: note = MG15-6 HNH domain
ELARSFKDRAAMDHRMKENYAKNEKIKERLSKEFHIMNPTGQDIVKWKLYEQQQGCCAYSQKPFDVDRLLHDGNYAEVDHILPYSRSFDDTYRNKVLVLEKENRDKGNRTPMEYLADKPERKEKFIAWVKTVIKDSKKREHLLRVKYGRDEEAEWKQRHL

SEQ ID NO: 4569 - protein, 160 aa, unidentified
  REGION 1..160: note = Description of Unknown:uncultivated organism with predicted taxonomy: Megasphaerastantonii
  REGION 1..160: note = MG15-7 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTATTENEWKRRNL

SEQ ID NO: 4570 - protein, 160 aa, unidentified
  REGION 1..160: note = Description of Unknown:uncultivated organism with predicted taxonomy: Dialister
  REGION 1..160: note = MG15-8 HNH domain
ELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKERFIAWVKTTIKDSKKREHLLRVKYGRDEEAEWKQRHL

SEQ ID NO: 4571 - protein, 160 aa, unidentified
  REGION 1..160: note = Description of Unknown:uncultivated organism with predicted taxonomy: Dialisterinvisus
  REGION 1..160: note = MG15-9 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNL

SEQ ID NO: 4572 - protein, 160 aa, unidentified
  REGION 1..160: note = Description of Unknown:uncultivated organism with predicted taxonomy: Dialister
  REGION 1..160: note = MG15-10 HNH domain
ELARNFRDRKKMEKGMQENQAKNEKIRQCLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4573 - protein, 160 aa, unidentified
  REGION 1..160: note = Description of Unknown:uncultivated organism with predicted taxonomy: Dialister
  REGION 1..160: note = MG15-11 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4574 - protein, 160 aa, unidentified
  REGION 1..160: note = Description of Unknown:uncultivated organism with predicted taxonomy: Megasphaeramicronuciformis
  REGION 1..160: note = MG15-12 HNH domain
ELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHL

SEQ ID NO: 4575 - protein, 160 aa, unidentified
  REGION 1..160: note = Description of Unknown:uncultivated organism with predicted taxonomy: Megasphaera sp.AM44-1BH
  REGION 1..160: note = MG15-13 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETIENEWKRRNL

SEQ ID NO: 4576 - protein, 160 aa, unidentified
  REGION 1..160: note = Description of Unknown:uncultivated organism with predicted taxonomy: Dialister
  REGION 1..160: note = MG15-14 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4577 - protein, 160 aa, unidentified
  REGION 1..160: note = Description of Unknown:uncultivated organism with predicted taxonomy: Megasphaeramicronuciformis
  REGION 1..160: note = MG15-15 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHL

SEQ ID NO: 4578 - protein, 159 aa, unidentified
  REGION 1..159: note = Description of Unknown:uncultivated organism with predicted taxonomy: Megasphaerastantonii
  REGION 1..159: note = MG15-16 HNH domain
ELAKSAKERTELEKAMKDNQSRNEKIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHL

SEQ ID NO: 4579 - protein, 160 aa, unidentified; identical to SEQ ID NO: 4573
  REGION 1..160: note = Description of Unknown:uncultivated organism with predicted taxonomy: Dialister
  REGION 1..160: note = MG15-17 HNH domain

SEQ ID NO: 4580 - protein, 160 aa, unidentified
  REGION 1..160: note = Description of Unknown:uncultivated organism with predicted taxonomy: Megasphaeramicronuciformis
  REGION 1..160: note = MG15-18 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKVRHL

SEQ ID NO: 4581 - protein, 160 aa, unidentified
  REGION 1..160: note = Description of Unknown:uncultivated organism with predicted taxonomy: Megasphaeramicronuciformis
  REGION 1..160: note = MG15-19 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYFSGDEARKKQFVAWVKSDIKKPRKRENLLREKFTADAENDWKIRHL

SEQ ID NO: 4582 - protein, 160 aa, unidentified; identical to SEQ ID NO: 4565
  REGION 1..160: note = Description of Unknown:uncultivated organism with predicted taxonomy: Dialister
  REGION 1..160: note = MG15-20 HNH domain

SEQ ID NO: 4583 - protein, 160 aa, unidentified; identical to SEQ ID NO: 4575
  REGION 1..160: note = Description of Unknown:uncultivated organism with predicted taxonomy: Dialister
  REGION 1..160: note = MG15-21 HNH domain

SEQ ID NO: 4584 - protein, 160 aa, unidentified
  REGION 1..160: note = Description of Unknown:uncultivated organism with predicted taxonomy: Dialister
  REGION 1..160: note = MG15-22 HNH domain
ELARSFRDRKKMEKGMQENQAKNEKIRQRLISEFGVLRPKGMDIVKSKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4585 - protein, 160 aa, unidentified
  REGION 1..160: note = Description of Unknown:uncultivated organism with predicted taxonomy: Dialister
  REGION 1..160: note = MG15-23 HNH domain
ELARNFRDRKKIEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4586 - protein, 160 aa, unidentified
  REGION 1..160: note = Description of Unknown:uncultivated organism with predicted taxonomy: Dialisterinvisus
  REGION 1..160: note = MG15-24 HNH domain
ELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNL

SEQ ID NO: 4587 - protein, 160 aa, unidentified; identical to SEQ ID NO: 4586
  REGION 1..160: note = Description of Unknown:uncultivated organism with predicted taxonomy: Dialister
  REGION 1..160: note = MG15-25 HNH domain

SEQ ID NO: 4588 - protein, 160 aa, unidentified; identical to SEQ ID NO: 4565
  REGION 1..160: note = Description of Unknown:uncultivated organism with predicted taxonomy: Dialister
  REGION 1..160: note = MG15-26 HNH domain

SEQ ID NO: 4589 - protein, 160 aa, unidentified; identical to SEQ ID NO: 4573
  REGION 1..160: note = Description of Unknown:uncultivated organism with predicted taxonomy: Dialister
  REGION 1..160: note = MG15-27 HNH domain

SEQ ID NO: 4590 - protein, 160 aa, unidentified; identical to SEQ ID NO: 4565
  REGION 1..160: note = Description of Unknown:uncultivated organism with predicted taxonomy: Dialister
  REGION 1..160: note = MG15-28 HNH domain

SEQ ID NO: 4591 - protein, 160 aa, unidentified; identical to SEQ ID NO: 4565
  REGION 1..160: note = Description of Unknown:uncultivated organism with predicted taxonomy: Dialisterinvisus
  REGION 1..160: note = MG15-29 HNH domain

SEQ ID NO: 4592 - protein, 160 aa, unidentified; identical to SEQ ID NO: 4575
  REGION 1..160: note = Description of Unknown:uncultivated organism with predicted taxonomy: Megasphaera sp.AM44-1BH
  REGION 1..160: note = MG15-30 HNH domain

SEQ ID NO: 4593 - protein, 160 aa, unidentified
  REGION 1..160: note = Description of Unknown:uncultivated organism with predicted taxonomy: Dialister
  REGION 1..160: note = MG15-31 HNH domain
ELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKRTIRNSRKRENLLRTDYTATTENEWKRRNL

SEQ ID NO: 4594 - protein, 160 aa, unidentified; identical to SEQ ID NO: 4565
  REGION 1..160: note = Description of Unknown:uncultivated organism with predicted taxonomy: Veillonellales
  REGION 1..160: note = MG15-32 HNH domain

SEQ ID NO: 4595 - protein, 160 aa, unidentified; identical to SEQ ID NO: 4573
  REGION 1..160: note = Description of Unknown:uncultivated organism with predicted taxonomy: Dialister
  REGION 1..160: note = MG15-33 HNH domain

SEQ ID NO: 4596 - protein, 160 aa, unidentified; identical to SEQ ID NO: 4586
  REGION 1..160: note = Description of Unknown:uncultivated organism with predicted taxonomy: Megasphaera
  REGION 1..160: note = MG15-34 HNH domain

SEQ ID NO: 4597 - protein, 159 aa, unidentified
  REGION 1..159: note = Description of Unknown:uncultivated organism with predicted taxonomy: Megasphaera
  REGION 1..159: note = MG15-35 HNH domain
ELAKSAKERTELEKAMKDNQSRNEKIKTKLHELNVMQPTGLDIVKYKLYKQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHL

SEQ ID NO: 4598 - protein, 160 aa, unidentified; identical to SEQ ID NO: 4586
  REGION 1..160: note = Description of Unknown:uncultivated organism with predicted taxonomy: Dialister
  REGION 1..160: note = MG15-36 HNH domain

SEQ ID NO: 4599 - protein, 160 aa, unidentified; identical to SEQ ID NO: 4586
  REGION 1..160: note = Description of Unknown:uncultivated organism with predicted taxonomy: Dialister
  REGION 1..160: note = MG15-37 HNH domain

SEQ ID NO: 4600 - protein, 160 aa, unidentified
  REGION 1..160: note = Description of Unknown:uncultivated organism with predicted taxonomy: Selenomonasbovis
  REGION 1..160: note = MG15-38 HNH domain
EMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNL

SEQ ID NO: 4601 - protein, 160 aa, unidentified; identical to SEQ ID NO: 4565
  REGION 1..160: note = Description of Unknown:uncultivated organism with predicted taxonomy: Dialister
  REGION 1..160: note = MG15-39 HNH domain

SEQ ID NO: 4602 - protein, 160 aa, unidentified; identical to SEQ ID NO: 4565
  REGION 1..160: note = Description of Unknown:uncultivated organism with predicted taxonomy: Dialister
  REGION 1..160: note = MG15-40 HNH domain

SEQ ID NO: 4603 - protein, 160 aa, unidentified
  REGION 1..160: note = Description of Unknown:uncultivated organism with predicted taxonomy: Megasphaera sp.AM44-1BH
  REGION 1..160: note = MG15-41 HNH domain
ELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHL

SEQ ID NO: 4604 - protein, 160 aa, unidentified
  REGION 1..160: note = Description of Unknown:uncultivated organism with predicted taxonomy: Veillonellales
  REGION 1..160: note = MG15-42 HNH domain
ELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHL

SEQ ID NO: 4605 - protein, 160 aa, unidentified; identical to SEQ ID NO: 4573
  REGION 1..160: note = Description of Unknown:uncultivated organism with predicted taxonomy: Veillonellales
  REGION 1..160: note = MG15-43 HNH domain

SEQ ID NO: 4606 - protein, 160 aa, unidentified; identical to SEQ ID NO: 4604
  REGION 1..160: note = Description of Unknown:uncultivated organism with predicted taxonomy: Veillonellales
  REGION 1..160: note = MG15-44 HNH domain

SEQ ID NO: 4607 - protein, 160 aa, unidentified; identical to SEQ ID NO: 4600
  REGION 1..160: note = Description of Unknown:uncultivated organism with predicted taxonomy: Selenomonasbovis
  REGION 1..160: note = MG15-45 HNH domain

SEQ ID NO: 4608 - protein, 160 aa, unidentified
  REGION 1..160: note = Description of Unknown:uncultivated organism with predicted taxonomy: Dialister
  REGION 1..160: note = MG15-46 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNL

SEQ ID NO: 4609 - protein, 160 aa, unidentified
  REGION 1..160: note = Description of Unknown:uncultivated organism with predicted taxonomy: Dialister
  REGION 1..160: note = MG15-47 HNH domain
ELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKEKFIAWVKTTIKDSKKREHLLRVKYGRDEEAEWKQRHL

SEQ ID NO: 4610 - protein, 160 aa, unidentified; identical to SEQ ID NO: 4600
  REGION 1..160: note = Description of Unknown:uncultivated organism with predicted taxonomy: Selenomonasbovis
  REGION 1..160: note = MG15-48 HNH domain

SEQ ID NO: 4611 - protein, 160 aa, unidentified; identical to SEQ ID NO: 4586
  REGION 1..160: note = Description of Unknown:uncultivated organism with predicted taxonomy: Dialister
  REGION 1..160: note = MG15-49 HNH domain

SEQ ID NO: 4612 - protein, 160 aa, unidentified; identical to SEQ ID NO: 4565
  REGION 1..160: note = Description of Unknown:uncultivated organism with predicted taxonomy: Dialister
  REGION 1..160: note = MG15-50 HNH domain

SEQ ID NO: 4613 - protein, 160 aa, unidentified; identical to SEQ ID NO: 4573
  REGION 1..160: note = Description of Unknown:uncultivated organism with predicted taxonomy: Dialister
  REGION 1..160: note = MG15-51 HNH domain

SEQ ID NO: 4614 - protein, 160 aa, unidentified; identical to SEQ ID NO: 4586
  REGION 1..160: note = Description of Unknown:uncultivated organism with predicted taxonomy: Veillonellales
  REGION 1..160: note = MG15-52 HNH domain

SEQ ID NO: 4615 - protein, 160 aa, unidentified; identical to SEQ ID NO: 4586
  REGION 1..160: note = Description of Unknown:uncultivated organism with predicted taxonomy: Dialisterinvisus
  REGION 1..160: note = MG15-53 HNH domain

SEQ ID NO: 4616 - protein, 160 aa, unidentified; identical to SEQ ID NO: 4573
  REGION 1..160: note = Description of Unknown:uncultivated organism with predicted taxonomy: Dialister
  REGION 1..160: note = MG15-54 HNH domain

SEQ ID NO: 4617 - protein, 160 aa, unidentified
  REGION 1..160: note = Description of Unknown:uncultivated organism with predicted taxonomy: Megasphaerastantonii
  REGION 1..160: note = MG15-55 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDVKKPRKRENLLREKFTADAENDWKVRHL

SEQ ID NO: 4618 - protein, 160 aa, unidentified; identical to SEQ ID NO: 4600
  REGION 1..160: note = Description of Unknown:uncultivated organism with predicted taxonomy: Selenomonasbovis
  REGION 1..160: note = MG15-56 HNH domain

SEQ ID NO: 4619 - protein, 160 aa, unidentified; identical to SEQ ID NO: 4573
  REGION 1..160: note = Description of Unknown:uncultivated organism with predicted taxonomy: Dialister
  REGION 1..160: note = MG15-57 HNH domain

SEQ ID NO: 4620 - protein, 160 aa, unidentified; identical to SEQ ID NO: 4608
  REGION 1..160: note = Description of Unknown:uncultivated organism with predicted taxonomy: Dialister
  REGION 1..160: note = MG15-58 HNH domain

SEQ ID NO: 4621 - protein, 160 aa, unidentified; identical to SEQ ID NO: 4608
  REGION 1..160: note = Description of Unknown:uncultivated organism with predicted taxonomy: Dialister
  REGION 1..160: note = MG15-59 HNH domain

SEQ ID NO: 4622 - protein, 160 aa, unidentified; identical to SEQ ID NO: 4586
  REGION 1..160: note = Description of Unknown:uncultivated organism with predicted taxonomy: Megasphaera
  REGION 1..160: note = MG15-60 HNH domain

SEQ ID NO: 4623 - protein, 160 aa, unidentified; identical to SEQ ID NO: 4586
  REGION 1..160: note = Description of Unknown:uncultivated organism with predicted taxonomy: Dialister
  REGION 1..160: note = MG15-61 HNH domain

SEQ ID NO: 4624 - protein, 160 aa, unidentified; identical to SEQ ID NO: 4580
  REGION 1..160: note = Description of Unknown:uncultivated organism with predicted taxonomy: Megasphaerastantonii
  REGION 1..160: note = MG15-62 HNH domain

SEQ ID NO: 4625 - protein, 160 aa, unidentified
  REGION 1..160: note = Description of Unknown:uncultivated organism with predicted taxonomy: Dialister
  REGION 1..160: note = MG15-63 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRLIHWVKSTIRNSRKRENLLRIDYTETTENEWKRRNL

SEQ ID NO: 4626 - protein, 160 aa, unidentified; identical to SEQ ID NO: 4608
  REGION 1..160: note = Description of Unknown:uncultivated organism with predicted taxonomy: Megasphaera
  REGION 1..160: note = MG15-64 HNH domain

SEQ ID NO: 4627 - protein, 160 aa, unidentified; identical to SEQ ID NO: 4565
  REGION 1..160: note = Description of Unknown:uncultivated organism with predicted taxonomy: Dialister
  REGION 1..160: note = MG15-65 HNH domain

SEQ ID NO: 4628 - protein, 160 aa, unidentified; identical to SEQ ID NO: 4577
  REGION 1..160: note = Description of Unknown:uncultivated organism with predicted taxonomy: Megasphaeramicronuciformis
  REGION 1..160: note = MG15-66 HNH domain

SEQ ID NO: 4629 - protein, 160 aa, unidentified
  REGION 1..160: note = Description of Unknown:uncultivated organism with predicted taxonomy: Megasphaerastantonii
  REGION 1..160: note = MG15-67 HNH domain
ELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHL

SEQ ID NO: 4630 - protein, 159 aa, unidentified
  REGION 1..159: note = Description of Unknown:uncultivated organism with predicted taxonomy: Veillonellaceaebacterium DNF00626
  REGION 1..159: note = MG15-68 HNH domain
DLGRNFKDRDLIKSNMEKNQKKNDEIKERIVNEFGIMQPKSQDIVKLKLCEQQDNVCVYSQKSFDLHRLFEKNYVEVDHIIPYSRSFDDTYANKVLVFNKENRDKGNKLPLEYLANQPERKEKFIAWVKSHIKDRKKRDNLLRESYSAEDKNGWKQRNL

SEQ ID NO: 4631 - protein, 160 aa, unidentified
  REGION 1..160: note = Description of Unknown:uncultivated organism with predicted taxonomy: Dialister
  REGION 1..160: note = MG15-69 HNH domain
ELARSFKDRAAMDDRMKENHAKNEEIKEYLSKELHVMSPTGQDIVKWKLYKQQQGYCAYSQKLFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHL

SEQ ID NO: 4632 - protein, 160 aa, unidentified; identical to SEQ ID NO: 4573
  REGION 1..160: note = Description of Unknown:uncultivated organism with predicted taxonomy: Dialister
  REGION 1..160: note = MG15-70 HNH domain

SEQ ID NO: 4633 - protein, 160 aa, unidentified; identical to SEQ ID NO: 4608
  REGION 1..160: note = Description of Unknown:uncultivated organism with predicted taxonomy: Dialister
  REGION 1..160: note = MG15-71 HNH domain

SEQ ID NO: 4634 - protein, 160 aa, unidentified; identical to SEQ ID NO: 4585
  REGION 1..160: note = Description of Unknown:uncultivated organism with predicted taxonomy: Dialister
  REGION 1..160: note = MG15-72 HNH domain

SEQ ID NO: 4635 - protein, 160 aa, unidentified; identical to SEQ ID NO: 4586
  REGION 1..160: note = Description of Unknown:uncultivated organism with predicted taxonomy: Dialisterinvisus
  REGION 1..160: note = MG15-73 HNH domain

SEQ ID NO: 4636 - protein, 160 aa, unidentified; identical to SEQ ID NO: 4586
  REGION 1..160: note = Description of Unknown:uncultivated organism with predicted taxonomy: Dialister
  REGION 1..160: note = MG15-74 HNH domain

SEQ ID NO: 4637 - protein, 160 aa, unidentified; identical to SEQ ID NO: 4586
  REGION 1..160: note = Description of Unknown:uncultivated organism with predicted taxonomy: Dialisterinvisus
  REGION 1..160: note = MG15-75 HNH domain

SEQ ID NO: 4638 - protein, 160 aa, unidentified; identical to SEQ ID NO: 4565
  REGION 1..160: note = Description of Unknown:uncultivated organism with predicted taxonomy: Dialister
  REGION 1..160: note = MG15-76 HNH domain

SEQ ID NO: 4639 - protein, 160 aa, unidentified; identical to SEQ ID NO: 4573
  REGION 1..160: note = Description of Unknown:uncultivated organism with predicted taxonomy: Dialisterinvisus
  REGION 1..160: note = MG15-77 HNH domain

SEQ ID NO: 4640 - protein, 160 aa, unidentified; identical to SEQ ID NO: 4586
  REGION 1..160: note = Description of Unknown:uncultivated organism with predicted taxonomy: Dialister
  REGION 1..160: note = MG15-78 HNH domain

SEQ ID NO: 4641 - protein, 160 aa, unidentified; identical to SEQ ID NO: 4565
  REGION 1..160: note = Description of Unknown:uncultivated organism with predicted taxonomy: Megasphaerastantonii
  REGION 1..160: note = MG15-79 HNH domain

SEQ ID NO: 4642 - protein, 160 aa, unidentified; identical to SEQ ID NO: 4575
  REGION 1..160: note = Description of Unknown:uncultivated organism with predicted taxonomy: Megasphaera sp.AM44-1BH
  REGION 1..160: note = MG15-80 HNH domain

SEQ ID NO: 4643 - protein, 160 aa, unidentified; identical to SEQ ID NO: 4565
  REGION 1..160: note = Description of Unknown:uncultivated organism with predicted taxonomy: Megasphaera
  REGION 1..160: note = MG15-81 HNH domain

SEQ ID NO: 4644 - protein, 160 aa, unidentified; identical to SEQ ID NO: 4575
  REGION 1..160: note = Description of Unknown:uncultivated organism with predicted taxonomy: Megasphaera sp.AM44-1BH
  REGION 1..160: note = MG15-82 HNH domain

SEQ ID NO: 4645 - protein, 159 aa, unidentified; identical to SEQ ID NO: 4630
  REGION 1..159: note = Description of Unknown:uncultivated organism with predicted taxonomy: Veillonellaceaebacterium DNF00626
  REGION 1..159: note = MG15-83 HNH domain

SEQ ID NO: 4646 - protein, 160 aa, unidentified; identical to SEQ ID NO: 4575
  REGION 1..160: note = Description of Unknown:uncultivated organism with predicted taxonomy: Dialister
  REGION 1..160: note = MG15-84 HNH domain

SEQ ID NO: 4647 - protein, 160 aa, unidentified; identical to SEQ ID NO: 4575
  REGION 1..160: note = Description of Unknown:uncultivated organism with predicted taxonomy: Dialister
  REGION 1..160: note = MG15-85 HNH domain

SEQ ID NO: 4648 - protein, 160 aa, unidentified; identical to SEQ ID NO: 4573
  REGION 1..160: note = Description of Unknown:uncultivated organism with predicted taxonomy: Dialister
  REGION 1..160: note = MG15-86 HNH domain

SEQ ID NO: 4649 - protein, 160 aa, unidentified; identical to SEQ ID NO: 4593
  REGION 1..160: note = Description of Unknown:uncultivated organism with predicted taxonomy: Dialister
  REGION 1..160: note = MG15-87 HNH domain

SEQ ID NO: 4650 - protein, 160 aa, unidentified
  REGION 1..160: note = Description of Unknown:uncultivated organism with predicted taxonomy: Megasphaera sp.AM44-1BH
  REGION 1..160: note = MG15-88 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENRKKRNRIPMEYLADATERKNRFIHWVKSTIRNSRKRENLLRTDYTETTENEWKRRNL

SEQ ID NO: 4651 - protein, 160 aa, unidentified; identical to SEQ ID NO: 4573
  REGION 1..160: note = Description of Unknown:uncultivated organism with predicted taxonomy: Dialister
  REGION 1..160: note = MG15-89 HNH domain

SEQ ID NO: 4652 - protein, 160 aa, unidentified; identical to SEQ ID NO: 4576
  REGION 1..160: note = Description of Unknown:uncultivated organism with predicted taxonomy: Dialister
  REGION 1..160: note = MG15-90 HNH domain

SEQ ID NO: 4653 - protein, 160 aa, unidentified; identical to SEQ ID NO: 4608
  REGION 1..160: note = Description of Unknown:uncultivated organism with predicted taxonomy: Dialister
  REGION 1..160: note = MG15-91 HNH domain

SEQ ID NO: 4654 - protein, 159 aa, unidentified; identical to SEQ ID NO: 4578
  REGION 1..159: note = Description of Unknown:uncultivated organism with predicted taxonomy: Firmicutes
  REGION 1..159: note = MG15-92 HNH domain

SEQ ID NO: 4655 - protein, 160 aa, unidentified
  REGION 1..160: note = Description of Unknown:uncultivated organism with predicted taxonomy: Megasphaeramicronuciformis
  REGION 1..160: note = MG15-93 HNH domain
ELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHL

SEQ ID NO: 4656 - protein, 160 aa, unidentified; identical to SEQ ID NO: 4586
  REGION 1..160: note = Description of Unknown:uncultivated organism with predicted taxonomy: Dialister
  REGION 1..160: note = MG15-94 HNH domain

SEQ ID NO: 4657 - protein, 160 aa, unidentified; identical to SEQ ID NO: 4586
  REGION 1..160: note = Description of Unknown:uncultivated organism with predicted taxonomy: Dialister
  REGION 1..160: note = MG15-95 HNH domain

SEQ ID NO: 4658 - protein, 160 aa, unidentified
  REGION 1..160: note = Description of Unknown:uncultivated organism with predicted taxonomy: Megasphaeramicronuciformis
  REGION 1..160: note = MG15-96 HNH domain
ELAKSFDERQKMTKSIEENQSHNERIKERLQKEFNVPYPSGQDIVKLKLYEEQNEICAYSQKHIDAAKLFHDPNYAEVDHIIPYSRSFDDTYNNKVLVLTAENRQKGNRTPMEYLSGDEARKKQFVAWVKSDIKKPRKRENLLREKFTTDAENDWKARHL

SEQ ID NO: 4659 - protein, 160 aa, unidentified; identical to SEQ ID NO: 4581
  REGION 1..160: note = Description of Unknown:uncultivated organism with predicted taxonomy: Megasphaeramicronuciformis
  REGION 1..160: note = MG15-97 HNH domain

SEQ ID NO: 4660 - protein, 160 aa, unidentified; identical to SEQ ID NO: 4565
  REGION 1..160: note = Description of Unknown:uncultivated organism with predicted taxonomy: Dialister
  REGION 1..160: note = MG15-98 HNH domain

SEQ ID NO: 4661 - protein, 160 aa, unidentified; identical to SEQ ID NO: 4577
  REGION 1..160: note = Description of Unknown:uncultivated organism with predicted taxonomy: Megasphaeramicronuciformis
  REGION 1..160: note = MG15-99 HNH domain

SEQ ID NO: 4662 - protein, 160 aa, unidentified; identical to SEQ ID NO: 4580
  REGION 1..160: note = Description of Unknown:uncultivated organism with predicted taxonomy: Megasphaerastantonii
  REGION 1..160: note = MG15-100 HNH domain

SEQ ID NO: 4663 - protein, 160 aa, unidentified; identical to SEQ ID NO: 4586
  REGION 1..160: note = Description of Unknown:uncultivated organism with predicted taxonomy: Dialister
  REGION 1..160: note = MG15-101 HNH domain

SEQ ID NO: 4664 - protein, 160 aa, unidentified; identical to SEQ ID NO: 4565
  REGION 1..160: note = Description of Unknown:uncultivated organism with predicted taxonomy: Megasphaera
  REGION 1..160: note = MG15-102 HNH domain

SEQ ID NO: 4665 - protein, 160 aa, unidentified; identical to SEQ ID NO: 4603
  REGION 1..160: note = Description of Unknown:uncultivated organism with predicted taxonomy: Megasphaera sp.AM44-1BH
  REGION 1..160: note = MG15-103 HNH domain

SEQ ID NO: 4666 - protein, 160 aa, unidentified
  REGION 1..160: note = Description of Unknown:uncultivated organism with predicted taxonomy: Dialister
  REGION 1..160: note = MG15-104 HNH domain
ELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4667 - protein, 160 aa, unidentified; identical to SEQ ID NO: 4577
  REGION 1..160: note = Description of Unknown:uncultivated organism with predicted taxonomy: Megasphaeramicronuciformis
  REGION 1..160: note = MG15-105 HNH domain

SEQ ID NO: 4668 - protein, 160 aa, unidentified; identical to SEQ ID NO: 4584
  REGION 1..160: note = Description of Unknown:uncultivated organism with predicted taxonomy: Dialister
  REGION 1..160: note = MG15-106 HNH domain

SEQ ID NO: 4669 - protein, 160 aa, unidentified; identical to SEQ ID NO: 4565
  REGION 1..160: note = Description of Unknown:uncultivated organism with predicted taxonomy: Dialister
  REGION 1..160: note = MG15-107 HNH domain

SEQ ID NO: 4670 - protein, 160 aa, unidentified; identical to SEQ ID NO: 4565
  REGION 1..160: note = Description of Unknown:uncultivated organism with predicted taxonomy: Dialister
  REGION 1..160: note = MG15-108 HNH domain

SEQ ID NO: 4671 - protein, 160 aa, unidentified; identical to SEQ ID NO: 4629
  REGION 1..160: note = Description of Unknown:uncultivated organism with predicted taxonomy: Megasphaerastantonii
  REGION 1..160: note = MG15-109 HNH domain

SEQ ID NO: 4672 - protein, 160 aa, unidentified; identical to SEQ ID NO: 4625
  REGION 1..160: note = Description of Unknown:uncultivated organism with predicted taxonomy: Dialister
  REGION 1..160: note = MG15-110 HNH domain

SEQ ID NO: 4673 - protein, 160 aa, unidentified; identical to SEQ ID NO: 4565
  REGION 1..160: note = Description of Unknown:uncultivated organism with predicted taxonomy: Veillonellales
  REGION 1..160: note = MG15-111 HNH domain

SEQ ID NO: 4674 - protein, 160 aa, unidentified; identical to SEQ ID NO: 4586
  REGION 1..160: note = Description of Unknown:uncultivated organism with predicted taxonomy: Dialister
  REGION 1..160: note = MG15-112 HNH domain

SEQ ID NO: 4675 - protein, 160 aa, unidentified; identical to SEQ ID NO: 4565
  REGION 1..160: note = Description of Unknown:uncultivated organism with predicted taxonomy: Dialister
  REGION 1..160: note = MG15-113 HNH domain

SEQ ID NO: 4676 - protein, 160 aa, unidentified
  REGION 1..160: note = Description of Unknown:uncultivated organism with predicted taxonomy: Veillonellales
  REGION 1..160: note = MG15-114 HNH domain
ELARSFKDRAAMDDRMKENHAKNEEIKEYLSKELHVMSPTGQDIVKWKLYKQQQGYCAYSQKPFDVNKLLHDRTYAEVDHILPYSRSFDDTYRNKVLVLTKENRDKGNRTPMEYLADKPERKGKFIAWVKTTIKDSKKREHLLRVKYGRDEEAEWKQRHL

SEQ ID NO: 4677 - protein, 160 aa, unidentified; identical to SEQ ID NO: 4565
  REGION 1..160: note = Description of Unknown:uncultivated organism with predicted taxonomy: Dialister
  REGION 1..160: note = MG15-115 HNH domain

SEQ ID NO: 4678 - protein, 160 aa, unidentified; identical to SEQ ID NO: 4575
  REGION 1..160: note = Description of Unknown:uncultivated organism with predicted taxonomy: Megasphaera sp.AM44-1BH
  REGION 1..160: note = MG15-116 HNH domain

SEQ ID NO: 4679 - protein, 159 aa, unidentified; identical to SEQ ID NO: 4597
  REGION 1..159: note = Description of Unknown:uncultivated organism with predicted taxonomy: Megasphaera
  REGION 1..159: note = MG15-117 HNH domain

SEQ ID NO: 4680 - protein, 160 aa, unidentified; identical to SEQ ID NO: 4573
  REGION 1..160: note = Description of Unknown:uncultivated organism with predicted taxonomy: Dialister
  REGION 1..160: note = MG15-118 HNH domain

SEQ ID NO: 4681 - protein, 160 aa, unidentified; identical to SEQ ID NO: 4609
  REGION 1..160: note = Description of Unknown:uncultivated organism with predicted taxonomy: Dialister
  REGION 1..160: note = MG15-119 HNH domain

SEQ ID NO: 4682 - protein, 160 aa, unidentified
  REGION 1..160: note = Description of Unknown:uncultivated organism with predicted taxonomy: Megasphaeramicronuciformis
  REGION 1..160: note = MG15-120 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLNGDEARKKQFVAWVKSDIKKPRKRENLLREKFTDDVENDWKERHL

SEQ ID NO: 4683 - protein, 160 aa, unidentified; identical to SEQ ID NO: 4577
  REGION 1..160: note = Description of Unknown:uncultivated organism with predicted taxonomy: Megasphaeramicronuciformis
  REGION 1..160: note = MG15-121 HNH domain

SEQ ID NO: 4684 - protein, 160 aa, unidentified; identical to SEQ ID NO: 4586
  REGION 1..160: note = Description of Unknown:uncultivated organism with predicted taxonomy: Dialisterinvisus
  REGION 1..160: note = MG15-122 HNH domain

SEQ ID NO: 4685 - protein, 160 aa, unidentified; identical to SEQ ID NO: 4573
  REGION 1..160: note = Description of Unknown:uncultivated organism with predicted taxonomy: Megasphaera
  REGION 1..160: note = MG15-123 HNH domain

SEQ ID NO: 4686 - protein, 160 aa, unidentified
  REGION 1..160: note = Description of Unknown:uncultivated organism with predicted taxonomy: Dialister
  REGION 1..160: note = MG15-124 HNH domain
ELARNFRDRKKMEKGMQENQAKNEKIRQRLISEFGVLRPKGMDIVKFRLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4687 - protein, 160 aa, unidentified; identical to SEQ ID NO: 4573
  REGION 1..160: note = Description of Unknown:uncultivated organism with predicted taxonomy: Dialister
  REGION 1..160: note = MG15-125 HNH domain

SEQ ID NO: 4688 - protein, 160 aa, unidentified
  REGION 1..160: note = Description of Unknown:uncultivated organism with predicted taxonomy: Megasphaerastantonii
  REGION 1..160: note = MG15-126 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKQRKRENLLREKFTADAENDWKARHL

SEQ ID NO: 4689 - protein, 160 aa, unidentified; identical to SEQ ID NO: 4608
  REGION 1..160: note = Description of Unknown:uncultivated organism with predicted taxonomy: Dialister
  REGION 1..160: note = MG15-127 HNH domain

SEQ ID NO: 4690 - protein, 160 aa, unidentified; identical to SEQ ID NO: 4608
  REGION 1..160: note = Description of Unknown:uncultivated organism with predicted taxonomy: Dialisterinvisus
  REGION 1..160: note = MG15-128 HNH domain

SEQ ID NO: 4691 - protein, 160 aa, unidentified; identical to SEQ ID NO: 4608
  REGION 1..160: note = Description of Unknown:uncultivated organism with predicted taxonomy: Dialister
  REGION 1..160: note = MG15-129 HNH domain

SEQ ID NO: 4692 - protein, 160 aa, unidentified; identical to SEQ ID NO: 4575
  REGION 1..160: note = Description of Unknown:uncultivated organism with predicted taxonomy: Dialister
  REGION 1..160: note = MG15-130 HNH domain

SEQ ID NO: 4693 - protein, 160 aa, unidentified; identical to SEQ ID NO: 4586
  REGION 1..160: note = Description of Unknown:uncultivated organism with predicted taxonomy: Dialister
  REGION 1..160: note = MG15-131 HNH domain

SEQ ID NO: 4694 - protein, 160 aa, unidentified; identical to SEQ ID NO: 4604
  REGION 1..160: note = Description of Unknown:uncultivated organism with predicted taxonomy: Veillonellamagna
  REGION 1..160: note = MG15-132 HNH domain

SEQ ID NO: 4695 - protein, 160 aa, unidentified; identical to SEQ ID NO: 4565
  REGION 1..160: note = Description of Unknown:uncultivated organism with predicted taxonomy: Dialister
  REGION 1..160: note = MG15-133 HNH domain

SEQ ID NO: 4696 - protein, 160 aa, unidentified; identical to SEQ ID NO: 4577
  REGION 1..160: note = Description of Unknown:uncultivated organism with predicted taxonomy: Megasphaeramicronuciformis
  REGION 1..160: note = MG15-134 HNH domain

SEQ ID NO: 4697 - protein, 160 aa, unidentified; identical to SEQ ID NO: 4580
  REGION 1..160: note = Description of Unknown:uncultivated organism with predicted taxonomy: Megasphaeramicronuciformis
  REGION 1..160: note = MG15-135 HNH domain

SEQ ID NO: 4698 - protein, 160 aa, unidentified; identical to SEQ ID NO: 4586
  REGION 1..160: note = Description of Unknown:uncultivated organism with predicted taxonomy: Megasphaerastantonii
  REGION 1..160: note = MG15-136 HNH domain

SEQ ID NO: 4699 - protein, 160 aa, unidentified; identical to SEQ ID NO: 4603
  REGION 1..160: note = Description of Unknown:uncultivated organism with predicted taxonomy: Megasphaera sp.AM44-1BH
  REGION 1..160: note = MG15-137 HNH domain

SEQ ID NO: 4700 - protein, 159 aa, unidentified
  REGION 1..159: note = Description of Unknown:uncultivated organism with predicted taxonomy: Megasphaera
  REGION 1..159: note = MG15-138 HNH domain
ELAKNAKERTELEKAMKDNQSRNEEIKTKLHELNVMQPTGLDIVKYKLYEQQQGDCAYSQKKFDVDRLLHDSTYAEVDHIIPYSRSFDDTYRNKVLVLTKENRDKGNRTPMEYFQDKPERKEAFVRWVKRTISDGKKRNNLLRVNYSADAEKEWKDRHL

SEQ ID NO: 4701 - protein, 159 aa, unidentified
  REGION 1..159: note = Description of Unknown:uncultivated organism with predicted taxonomy: Megasphaera
  REGION 1..159: note = MG15-139 HNH domain
ELAKSAKERTELEKAMKDNQSRNEEIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHL

SEQ ID NO: 4702 - protein, 160 aa, unidentified; identical to SEQ ID NO: 4603
  REGION 1..160: note = Description of Unknown:uncultivated organism with predicted taxonomy: Megasphaera sp.AM44-1BH
  REGION 1..160: note = MG15-140 HNH domain

SEQ ID NO: 4703 - protein, 160 aa, unidentified; identical to SEQ ID NO: 4608
  REGION 1..160: note = Description of Unknown:uncultivated organism with predicted taxonomy: Dialister
  REGION 1..160: note = MG15-141 HNH domain

SEQ ID NO: 4704 - protein, 160 aa, unidentified; identical to SEQ ID NO: 4603
  REGION 1..160: note = Description of Unknown:uncultivated organism with predicted taxonomy: Megasphaera sp.AM44-1BH
  REGION 1..160: note = MG15-142 HNH domain

SEQ ID NO: 4705 - protein, 160 aa, unidentified; identical to SEQ ID NO: 4574
  REGION 1..160: note = Description of Unknown:uncultivated organism with predicted taxonomy: Megasphaeramicronuciformis
  REGION 1..160: note = MG15-143 HNH domain

SEQ ID NO: 4706 - protein, 160 aa, unidentified; identical to SEQ ID NO: 4655
  REGION 1..160: note = Description of Unknown:uncultivated organism with predicted taxonomy: Megasphaerastantonii
  REGION 1..160: note = MG15-144 HNH domain

SEQ ID NO: 4707 - protein, 160 aa, unidentified; identical to SEQ ID NO: 4577
  REGION 1..160: note = Description of Unknown:uncultivated organism with predicted taxonomy: Megasphaerastantonii
  REGION 1..160: note = MG15-145 HNH domain

SEQ ID NO: 4708 - protein, 160 aa, unidentified
  REGION 1..160: note = Description of Unknown:uncultivated organism with predicted taxonomy: Megasphaerastantonii
  REGION 1..160: note = MG15-146 HNH domain
EMGRSFQERRDMMKSMEDNNAANEKLKEEIKKDYGIAHPNGLDIVKYKLFKEQGERCAYSLKPMDARQVLKDPSYAEVDHILPYSRSFDDSYANKVLVLAKENRDKGNRTPMEYMANLPERKHAFITWVKSNVRNPKKRDNLLLEKFDGDKEDAWKERHL

SEQ ID NO: 4709 - protein, 158 aa, unidentified
  REGION 1..158: note = Description of Unknown:uncultivated organism with predicted taxonomy: Selenomonasruminantium
  REGION 1..158: note = MG15-147 HNH domain
EMARSKKDRDAMTTSMEKNRAENETIKRELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHL

SEQ ID NO: 4710 - protein, 158 aa, unidentified
  REGION 1..158: note = Description of Unknown:uncultivated organism with predicted taxonomy: Selenomonas sp.AE3005
  REGION 1..158: note = MG15-148 HNH domain
EMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHL

SEQ ID NO: 4711 - protein, 158 aa, unidentified
  REGION 1..158: note = Description of Unknown:uncultivated organism with predicted taxonomy: Selenomonasruminantium
  REGION 1..158: note = MG15-149 HNH domain
EMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHL

SEQ ID NO: 4712 - protein, 159 aa, unidentified
  REGION 1..159: note = Description of Unknown:uncultivated organism with predicted taxonomy: Selenomonasruminantium
  REGION 1..159: note = MG15-150 HNH domain
EMGRTFQERREMMKSMEDNNTKNEKLKEELKDYGVAHPSGLDIVKLKLYKEQGGVCAYSLAAMPIEKVLNDYDYAEVDHILPYSRSFDDSYANKVLVLAKENRDKGNRTPMEYMEKTPGKKHDFVTWVKASVRNPKKRDNLLLEKFDEDKEAAWKERHL

SEQ ID NO: 4713 - protein, 158 aa, unidentified
  REGION 1..158: note = Description of Unknown:uncultivated organism with predicted taxonomy: Selenomonas sp.AE3005
  REGION 1..158: note = MG15-151 HNH domain
EMARNFQDRRDMRHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHL

SEQ ID NO: 4714 - protein, 162 aa, unidentified
  REGION 1..162: note = Description of Unknown:uncultivated organism with predicted taxonomy: Selenomonas sp.AE3005
  REGION 1..162: note = MG15-152 HNH domain
EMARSFQDRKDMHNKMENNRKANEQIIKELRENGLLQPNGLDIVKWKLYKEQQGVCAYSQKTFDVERLLHDGKYDGKYAEVDHILPYSRSFDDSYTNKVLVMAGENQHKGNRTPWEYMRDNEEKWTSFACWTNTAIRDFRKRQNLLRKNFCSEEKEWKERHL

SEQ ID NO: 4715 - protein, 158 aa, unidentified
  REGION 1..158: note = Description of Unknown:uncultivated organism with predicted taxonomy: Selenomonas sp.AE3005
  REGION 1..158: note = MG15-153 HNH domain
EMARSFQDRRDMHNKMENNRKANEQIIKELRENGLLQPNGLDIVKWKLYKEQQGICAYSQKTFDVERLLHDGKYAEVDHILPYSRSFDDSYTNKVLVMAGENQHKGNRTPWEYMRDNEEKWTSFACWTNTAIRDFRKRQNLLRKNFCSEEKEWKERHL

SEQ ID NO: 4716 - protein, 158 aa, unidentified; identical to SEQ ID NO: 4711
  REGION 1..158: note = Description of Unknown:uncultivated organism with predicted taxonomy: Selenomonasruminantium
  REGION 1..158: note = MG15-154 HNH domain

SEQ ID NO: 4717 - protein, 158 aa, unidentified
  REGION 1..158: note = Description of Unknown:uncultivated organism with predicted taxonomy: Selenomonas sp.AE3005
  REGION 1..158: note = MG15-155 HNH domain
EMARSFQDRKDMHNKMENNRKANEQIIKELRENGLLQPNGLDIVKWKLYKEQQGVCAYSQKTFDVERLLHDGKYAEVDHILPYSRSFDDSYTNKVLVMAGENQHKGNRTPWEYMSNNEEKWTAFACWTNTAIRDFRKRQNLLRKKFCSEEKEWKERHL

SEQ ID NO: 4718 - protein, 158 aa, unidentified
  REGION 1..158: note = Description of Unknown:uncultivated organism with predicted taxonomy: Selenomonas sp.AE3005
  REGION 1..158: note = MG15-156 HNH domain
EMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKQNAFVCWANTSIRDLRKRQNLLRKNFHSEEKEWKDRHL

SEQ ID NO: 4719 - protein, 159 aa, unidentified
  REGION 1..159: note = Description of Unknown:uncultivated organism with predicted taxonomy: Megasphaerastantonii
  REGION 1..159: note = MG15-157 HNH domain
EMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHL

SEQ ID NO: 4720 - protein, 158 aa, unidentified; identical to SEQ ID NO: 4711
  REGION 1..158: note = Description of Unknown:uncultivated organism with predicted taxonomy: Selenomonasruminantium
  REGION 1..158: note = MG15-158 HNH domain

SEQ ID NO: 4721 - protein, 158 aa, unidentified; identical to SEQ ID NO: 4711
  REGION 1..158: note = Description of Unknown:uncultivated organism with predicted taxonomy: Selenomonasruminantium
  REGION 1..158: note = MG15-159 HNH domain

SEQ ID NO: 4722 - protein, 159 aa, unidentified; identical to SEQ ID NO: 4719
  REGION 1..159: note = Description of Unknown:uncultivated organism with predicted taxonomy: Megasphaerastantonii
  REGION 1..159: note = MG15-160 HNH domain

SEQ ID NO: 4723 - protein, 160 aa, unidentified; identical to SEQ ID NO: 4600
  REGION 1..160: note = Description of Unknown:uncultivated organism with predicted taxonomy: Selenomonas sp.AE3005
  REGION 1..160: note = MG15-161 HNH domain

SEQ ID NO: 4724 - protein, 160 aa, unidentified
  REGION 1..160: note = Description of Unknown:uncultivated organism with predicted taxonomy: Megasphaera
  REGION 1..160: note = MG15-162 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRIDYTETTENEWKRRNL

SEQ ID NO: 4725 - protein, 160 aa, unidentified
  REGION 1..160: note = Description of Unknown:uncultivated organism with predicted taxonomy: Megasphaerastantonii
  REGION 1..160: note = MG15-163 HNH domain
ELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIWNSRKRENLLRIDYTETTENEWKRRNL

SEQ ID NO: 4726 - protein, 160 aa, unidentified
  REGION 1..160: note = Description of Unknown:uncultivated organism with predicted taxonomy: Megasphaera
  REGION 1..160: note = MG15-164 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4727 - protein, 160 aa, unidentified; identical to SEQ ID NO: 4565
  REGION 1..160: note = Description of Unknown:uncultivated organism with predicted taxonomy: Megasphaerastantonii
  REGION 1..160: note = MG15-165 HNH domain

SEQ ID NO: 4728 - protein, 160 aa, unidentified
  REGION 1..160: note = Description of Unknown:uncultivated organism with predicted taxonomy: Bacteroidales
  REGION 1..160: note = MG16-2 HNH domain
ELKQSREERELTDKNNRNRQKENDSNAKLIEEYGIRASRNRIQKYRMWKESRQTCFYCGQVVDVKDFLRGYDVEVEHIIPKALFFDDSFSNKVCSCRKCNSEKGERTAYDYMSSKGEDELNRYIRTVEDRCKKGEISKTKRERLLTPADKIPTDFINRQL

SEQ ID NO: 4729 - protein, 160 aa, unidentified
  REGION 1..160: note = Description of Unknown:uncultivated organism with predicted taxonomy: Bacteroidales
  REGION 1..160: note = MG16-5 HNH domain
ELKSSKDEREAAFKRNNENERQNKIYENRIREYGIQPSRSRIQKYKMWEESNHLCFYCGKPVNVTDFLAGAEVEIEHIIPQSVLFDDSYSNKVCACRACNQAKGNLTAREFMEKHSKEEYDSYLRRVDDAFNAHRISKTKRDHLLWRKEDIPQDFIDRQL

SEQ ID NO: 4730 - protein, 160 aa, unidentified; identical to SEQ ID NO: 4729
  REGION 1..160: note = Description of Unknown:uncultivated organism with predicted taxonomy: Bacteroidetes
  REGION 1..160: note = MG16-6 HNH domain

SEQ ID NO: 4731 - protein, 160 aa, unidentified
  REGION 1..160: note = Description of Unknown:uncultivated organism with predicted taxonomy: Bacteroides
  REGION 1..160: note = MG16-7 HNH domain
ELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQL

SEQ ID NO: 4732 - protein, 160 aa, unidentified; identical to SEQ ID NO: 4731
  REGION 1..160: note = Description of Unknown:uncultivated organism with predicted taxonomy: Bacteroides
  REGION 1..160: note = MG16-8 HNH domain

SEQ ID NO: 4733 - protein, 160 aa, unidentified; identical to SEQ ID NO: 4731
  REGION 1..160: note = Description of Unknown:uncultivated organism with predicted taxonomy: Bacteroides sp.CAG:770
  REGION 1..160: note = MG16-9 HNH domain

SEQ ID NO: 4734 - protein, 160 aa, unidentified; identical to SEQ ID NO: 4731
  REGION 1..160: note = Description of Unknown:uncultivated organism with predicted taxonomy: Bacteroides
  REGION 1..160: note = MG16-10 HNH domain

SEQ ID NO: 4735 - protein, 160 aa, unidentified; identical to SEQ ID NO: 4731
  REGION 1..160: note = Description of Unknown:uncultivated organism with predicted taxonomy: Bacteroides
  REGION 1..160: note = MG16-11 HNH domain

SEQ ID NO: 4736 - protein, 160 aa, unidentified; identical to SEQ ID NO: 4729
  REGION 1..160: note = Description of Unknown:uncultivated organism with predicted taxonomy: Bacteroidetes
  REGION 1..160: note = MG16-12 HNH domain

SEQ ID NO: 4737 - protein, 160 aa, unidentified; identical to SEQ ID NO: 4731
  REGION 1..160: note = Description of Unknown:uncultivated organism with predicted taxonomy: Bacteroides
  REGION 1..160: note = MG16-13 HNH domain

SEQ ID NO: 4738 - protein, 160 aa, unidentified; identical to SEQ ID NO: 4731
  REGION 1..160: note = Description of Unknown:uncultivated organism with predicted taxonomy: Bacteroides sp.CAG:770
  REGION 1..160: note = MG16-14 HNH domain

SEQ ID NO: 4739 - protein, 160 aa, unidentified
  REGION 1..160: note = Description of Unknown:uncultivated organism with predicted taxonomy: Bacteroides sp.CAG:770
  REGION 1..160: note = MG16-15 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPTDKLPKDFISRQL

SEQ ID NO: 4740 - protein, 160 aa, unidentified
  REGION 1..160: note = Description of Unknown:uncultivated organism with predicted taxonomy: Bacteroides sp.CAG:709
  REGION 1..160: note = MG16-16 HNH domain
ELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4741 - protein, 160 aa, unidentified
  REGION 1..160: note = Description of Unknown:uncultivated organism with predicted taxonomy: Bacteroides sp.CAG:770
  REGION 1..160: note = MG16-17 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4742 - protein, 160 aa, unidentified
  REGION 1..160: note = Description of Unknown:uncultivated organism with predicted taxonomy: Bacteroides sp.CAG:770
  REGION 1..160: note = MG16-18 HNH domain
ELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQL

SEQ ID NO: 4743 - protein, 160 aa, unidentified
  REGION 1..160: note = Description of Unknown:uncultivated organism with predicted taxonomy: Bacteroides sp.CAG:770
  REGION 1..160: note = MG16-19 HNH domain
ELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENTISQTKRNRLLTPADKIPKDFIARQL

SEQ ID NO: 4744 - protein, 160 aa, unidentified
  REGION 1..160: note = Description of Unknown:uncultivated organism with predicted taxonomy: Bacteroides sp.CAG:770
  REGION 1..160: note = MG16-20 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQL

SEQ ID NO: 4745 - protein, 160 aa, unidentified
  REGION 1..160: note = Description of Unknown:uncultivated organism with predicted taxonomy: Bacteroides sp.CAG:770
  REGION 1..160: note = MG16-21 HNH domain
ELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4746 - protein, 160 aa, unidentified
  REGION 1..160: note = Description of Unknown:uncultivated organism with predicted taxonomy: Bacteroides sp.CAG:770
  REGION 1..160: note = MG16-22 HNH domain
ELKLSKSGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4747 - protein, 160 aa, unidentified
  REGION 1..160: note = Description of Unknown:uncultivated organism with predicted taxonomy: Bacteroidales
  REGION 1..160: note = MG16-23 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQL

SEQ ID NO: 4748 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-24 HNH domain

SEQ ID NO: 4749 - protein, 160 aa, unidentified
  REGION 1..160: note = Description of Unknown:uncultivated organism with predicted taxonomy: Bacteroides sp.CAG:770
  REGION 1..160: note = MG16-25 HNH domain
ELKLSKEGRESAAKNIRAREKANEEIARRIEELGLVPSKNKILKYRLWEESVKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQL

SEQ ID NO: 4750 - protein, 160 aa, unidentified; identical to SEQ ID NO: 4741
  REGION 1..160: note = Description of Unknown:uncultivated organism with predicted taxonomy: Bacteroides
  REGION 1..160: note = MG16-26 HNH domain

SEQ ID NO: 4751 - protein, 160 aa, unidentified
  REGION 1..160: note = Description of Unknown:uncultivated organism with predicted taxonomy: Bacteroides sp.CAG:770
  REGION 1..160: note = MG16-27 HNH domain
ELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKGNATAFDYMKGRGENAFEDYLKRVEAAFKENKISQTKRNRLLTPADKIPKDFISRQL

SEQ ID NO: 4752 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-28 HNH domain

SEQ ID NO: 4753 - protein, 160 aa, unidentified
  REGION 1..160: note = Description of Unknown:uncultivated organism with predicted taxonomy: Bacteroides sp.CAG:709
  REGION 1..160: note = MG16-29 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRKSTAYDYMKSKGENAFNDYLRRVDTAFSEHKISFTKRSRLLTPADKIPKDFISRQL

SEQ ID NO: 4754 - protein, 160 aa, unidentified
  REGION 1..160: note = Description of Unknown:uncultivated organism with predicted taxonomy: Bacteroides sp.CAG:709
  REGION 1..160: note = MG16-30 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4755 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-31 HNH domain

SEQ ID NO: 4756 - protein, 160 aa, unidentified
  REGION 1..160: note = Description of Unknown:uncultivated organism with predicted taxonomy: Alistipes sp.CAG:514
  REGION 1..160: note = MG16-32 HNH domain
ELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQL

SEQ ID NO: 4757 - protein, 160 aa, unidentified; identical to SEQ ID NO: 4756
  REGION 1..160: note = Description of Unknown:uncultivated organism with predicted taxonomy: Alistipes sp.CAG:514
  REGION 1..160: note = MG16-33 HNH domain

SEQ ID NO: 4758 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-34 HNH domain

SEQ ID NO: 4759 - protein, 160 aa, unidentified; identical to SEQ ID NO: 4742
  REGION 1..160: note = Description of Unknown:uncultivated organism with predicted taxonomy: Bacteroides sp.CAG:770
  REGION 1..160: note = MG16-35 HNH domain

SEQ ID NO: 4760 - protein, 160 aa, unidentified; identical to SEQ ID NO: 4741
  REGION 1..160: note = Description of Unknown:uncultivated organism with predicted taxonomy: Bacteroides
  REGION 1..160: note = MG16-36 HNH domain

SEQ ID NO: 4761 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-37 HNH domain

SEQ ID NO: 4762 - protein, 160 aa, unidentified; identical to SEQ ID NO: 4741
  REGION 1..160: note = Description of Unknown:uncultivated organism with predicted taxonomy: Bacteroides
  REGION 1..160: note = MG16-38 HNH domain

SEQ ID NO: 4763 - protein, 160 aa, unidentified
  REGION 1..160: note = Description of Unknown:uncultivated organism with predicted taxonomy: Bacteroides sp.CAG:770
  REGION 1..160: note = MG16-39 HNH domain
ELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4764 - protein, 160 aa, unidentified; identical to SEQ ID NO: 4754
  REGION 1..160: note = Description of Unknown:uncultivated organism with predicted taxonomy: Bacteroides sp.CAG:770
  REGION 1..160: note = MG16-40 HNH domain

SEQ ID NO: 4765 - protein, 160 aa, unidentified
  REGION 1..160: note = Description of Unknown:uncultivated organism with predicted taxonomy: Bacteroides sp.CAG:770
  REGION 1..160: note = MG16-42 HNH domain
ELKLSKEGRESAAKNIRAREKANEEIAKRIEELGLLPSKNKILKYRLWEESGKRCFYCGQPVSATEFLNGLDVEIEHVVPKSLLFDDSFSNKVCACRKCNAEKGNATAFDFMNGRGENAFEDYLKRVETAFKENKISQTKRNRLLTPADKIPKDFISRQL

SEQ ID NO: 4766 - protein, 160 aa, unidentified; identical to SEQ ID NO: 4765
  REGION 1..160: note = Description of Unknown:uncultivated organism with predicted taxonomy: Bacteroides sp.CAG:770
  REGION 1..160: note = MG16-43 HNH domain

SEQ ID NO: 4767 - protein, 160 aa, unidentified
  REGION 1..160: note = Description of Unknown:uncultivated organism with predicted taxonomy: Bacteroides sp.CAG:770
  REGION 1..160: note = MG16-44 HNH domain
ELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQL

SEQ ID NO: 4768 - protein, 160 aa, unidentified; identical to SEQ ID NO: 4742
  REGION 1..160: note = Description of Unknown:uncultivated organism with predicted taxonomy: Bacteroides sp.CAG:770
  REGION 1..160: note = MG16-45 HNH domain

SEQ ID NO: 4769 - protein, 160 aa, unidentified
  REGION 1..160: note = Description of Unknown:uncultivated organism with predicted taxonomy: Bacteroides sp.CAG:770
  REGION 1..160: note = MG16-46 HNH domain
ELKLSKEGRAATAKNLRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4770 - protein, 160 aa, unidentified
  REGION 1..160: note = Description of Unknown:uncultivated organism with predicted taxonomy: Bacteroides sp.CAG:709
  REGION 1..160: note = MG16-47 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHRISFTKRSRLLTPADKIPKDFISRQL

SEQ ID NO: 4771 - protein, 160 aa, unidentified
  REGION 1..160: note = Description of Unknown:uncultivated organism with predicted taxonomy: Bacteroides sp.CAG:770
  REGION 1..160: note = MG16-48 HNH domain
ELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4772 - protein, 160 aa, unidentified; identical to SEQ ID NO: 4771
  REGION 1..160: note = Description of Unknown:uncultivated organism with predicted taxonomy: Bacteroides sp.CAG:770
  REGION 1..160: note = MG16-50 HNH domain

SEQ ID NO: 4773 - protein, 160 aa, unidentified; identical to SEQ ID NO: 4771
  REGION 1..160: note = Description of Unknown:uncultivated organism with predicted taxonomy: Bacteroides sp.CAG:770
  REGION 1..160: note = MG16-51 HNH domain

SEQ ID NO: 4774 - protein, 160 aa, unidentified; identical to SEQ ID NO: 4763
  REGION 1..160: note = Description of Unknown:uncultivated organism with predicted taxonomy: Bacteroides sp.CAG:770
  REGION 1..160: note = MG16-52 HNH domain

SEQ ID NO: 4775 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-53 HNH domain

SEQ ID NO: 4776 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-54 HNH domain

SEQ ID NO: 4777 - protein, 160 aa, unidentified
  REGION 1..160: note = Description of Unknown:uncultivated organism with predicted taxonomy: Bacteroides sp.CAG:770
  REGION 1..160: note = MG16-55 HNH domain
ELKLSKEGRESAAKNISDRKKANEEIARRIEELGLVPSKNKILKYRLWEESGKRCFYCGQPVSATEFLNGLDVEIEHVIPKSLLFDDSFSNKVCACRKCNAEKGNATAFDFMKGRGENAFEDYLKRVETAFKENRISQTKRSRLLTPADKIPKDFISRQL

SEQ ID NO: 4778 - protein, 160 aa, unidentified
  REGION 1..160: note = Description of Unknown:uncultivated organism with predicted taxonomy: Bacteroides sp.CAG:545
  REGION 1..160: note = MG16-56 HNH domain
KLKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4779 - protein, 160 aa, unidentified; identical to SEQ ID NO: 4743
  REGION 1..160: note = Description of Unknown:uncultivated organism with predicted taxonomy: Bacteroides sp.CAG:770
  REGION 1..160: note = MG16-57 HNH domain

SEQ ID NO: 4780 - protein, 160 aa, unidentified
  REGION 1..160: note = Description of Unknown:uncultivated organism with predicted taxonomy: Bacteroides sp.CAG:770
  REGION 1..160: note = MG16-58 HNH domain
ELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQL

SEQ ID NO: 4781 - protein, 160 aa, unidentified
  REGION 1..160: note = Description of Unknown:uncultivated organism with predicted taxonomy: Bacteroides sp.CAG:770
  REGION 1..160: note = MG16-59 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNNTAYDYMKSKGENEFNDYLRRVDAAFNEHKISFTKRSRLLTPADKLPKDFISRQL

SEQ ID NO: 4782 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-60 HNH domain

SEQ ID NO: 4783 - protein, 160 aa, unidentified
  REGION 1..160: note = Description of Unknown:uncultivated organism with predicted taxonomy: Bacteroides sp.CAG:709
  REGION 1..160: note = MG16-61 HNH domain
ELKLSKEGRAATAKNIRDREKENKEIAEKIIELGVTPSKNKILKYRLWQEAGQKCFYCGQPVGATEFLNGLEVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4784 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-62 HNH domain

SEQ ID NO: 4785 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-63 HNH domain

SEQ ID NO: 4786 - protein, 160 aa, unidentified; identical to SEQ ID NO: 4756
  REGION 1..160: note = Description of Unknown:uncultivated organism with predicted taxonomy: Alistipes sp.CAG:514
  REGION 1..160: note = MG16-64 HNH domain

SEQ ID NO: 4787 - protein, 160 aa, unidentified
  REGION 1..160: note = Description of Unknown:uncultivated organism with predicted taxonomy: Bacteroides sp.CAG:770
  REGION 1..160: note = MG16-65 HNH domain
ELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQL

SEQ ID NO: 4788 - protein, 160 aa, unidentified
  REGION 1..160: note = Description of Unknown:uncultivated organism with predicted taxonomy: Bacteroides sp.CAG:770
  REGION 1..160: note = MG16-66 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNAHKISFTKRSRLLTPADKLPKDFISRQL

SEQ ID NO: 4789 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-67 HNH domain

SEQ ID NO: 4790 - protein, 160 aa, unidentified; identical to SEQ ID NO: 4744
  REGION 1..160: note = Description of Unknown:uncultivated organism with predicted taxonomy: Bacteroides sp.CAG:770
  REGION 1..160: note = MG16-68 HNH domain

SEQ ID NO: 4791 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-69 HNH domain

SEQ ID NO: 4792 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-70 HNH domain

SEQ ID NO: 4793 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-72 HNH domain

SEQ ID NO: 4794 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-73 HNH domain

SEQ ID NO: 4795 - protein, 160 aa, unidentified
  REGION 1..160: note = Description of Unknown:uncultivated organism with predicted taxonomy: Bacteroides sp.CAG:770
  REGION 1..160: note = MG16-74 HNH domain
ELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKDNATAFDFMKGRGENAFEDYLKRVETAFKENKISQTKRNRLLTPADKIPKDFISRQL

SEQ ID NO: 4796 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-75 HNH domain

SEQ ID NO: 4797 - protein, 160 aa, unidentified; identical to SEQ ID NO: 4754
  REGION 1..160: note = Description of Unknown:uncultivated organism with predicted taxonomy: Bacteroides
  REGION 1..160: note = MG16-76 HNH domain

SEQ ID NO: 4798 - protein, 160 aa, unidentified
  REGION 1..160: note = Description of Unknown:uncultivated organism with predicted taxonomy: Bacteroides sp.CAG:770
  REGION 1..160: note = MG16-77 HNH domain
ELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4799 - protein, 160 aa, unidentified; identical to SEQ ID NO: 4747
  REGION 1..160: note = Description of Unknown:uncultivated organism with predicted taxonomy: Bacteroides
  REGION 1..160: note = MG16-78 HNH domain

SEQ ID NO: 4800 - protein, 160 aa, unidentified
  REGION 1..160: note = Description of Unknown:uncultivated organism with predicted taxonomy: Bacteroides sp.CAG:770
  REGION 1..160: note = MG16-79 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHRISFIKRSRLLTPADKLPKDFISRQL

SEQ ID NO: 4801 - protein, 160 aa, unidentified; identical to SEQ ID NO: 4769
  REGION 1..160: note = Description of Unknown:uncultivated organism with predicted taxonomy: Bacteroides sp.CAG:545
  REGION 1..160: note = MG16-80 HNH domain

SEQ ID NO: 4802 - protein, 160 aa, unidentified; identical to SEQ ID NO: 4754
  REGION 1..160: note = Description of Unknown:uncultivated organism with predicted taxonomy: Bacteroides
  REGION 1..160: note = MG16-81 HNH domain

SEQ ID NO: 4803 - protein, 160 aa, unidentified
  REGION 1..160: note = Description of Unknown:uncultivated organism with predicted taxonomy: Bacteroides sp.CAG:770
  REGION 1..160: note = MG16-82 HNH domain
ELKLSKEGRAATAKNIRDREKMNNEMAEKIKELGITPSKNKLLKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQL

SEQ ID NO: 4804 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-83 HNH domain

SEQ ID NO: 4805 - protein, 160 aa, unidentified
  REGION 1..160: note = Description of Unknown:uncultivated organism with predicted taxonomy: Bacteroidetes
  REGION 1..160: note = MG16-84 HNH domain
ELKESKDERESAFKRNNENERKNKEYEARIREYGIRPSRSRIQKYKMWEESQKKCFYCGKTIDVVEFLNGVDAEIEHIIPQSVLFDDSFSNKVCSCRDCNHTKGNLTAREFMEQHSAADYEAYLRRVDEAFDEHRISKTKRDHLLWRKEDIPQDFIDRQL

SEQ ID NO: 4806 - protein, 160 aa, unidentified; identical to SEQ ID NO: 4741
  REGION 1..160: note = Description of Unknown:uncultivated organism with predicted taxonomy: Bacteroides
  REGION 1..160: note = MG16-85 HNH domain

SEQ ID NO: 4807 - protein, 160 aa, unidentified; identical to SEQ ID NO: 4744
  REGION 1..160: note = Description of Unknown:uncultivated organism with predicted taxonomy: Bacteroides sp.CAG:545
  REGION 1..160: note = MG16-86 HNH domain

SEQ ID NO: 4808 - protein, 160 aa, unidentified; identical to SEQ ID NO: 4744
  REGION 1..160: note = Description of Unknown:uncultivated organism with predicted taxonomy: Bacteroides
  REGION 1..160: note = MG16-87 HNH domain

SEQ ID NO: 4809 - protein, 160 aa, unidentified; identical to SEQ ID NO: 4740
  REGION 1..160: note = Description of Unknown:uncultivated organism with predicted taxonomy: Bacteroides
  REGION 1..160: note = MG16-88 HNH domain

SEQ ID NO: 4810 - protein, 160 aa, unidentified; identical to SEQ ID NO: 4753
  REGION 1..160: note = Description of Unknown:uncultivated organism with predicted taxonomy: Bacteroides sp.CAG:709
  REGION 1..160: note = MG16-89 HNH domain

SEQ ID NO: 4811 - protein, 160 aa, unidentified; identical to SEQ ID NO: 4780
  REGION 1..160: note = Description of Unknown:uncultivated organism with predicted taxonomy: Bacteroides sp.CAG:770
  REGION 1..160: note = MG16-90 HNH domain

SEQ ID NO: 4812 - protein, 160 aa, unidentified; identical to SEQ ID NO: 4780
  REGION 1..160: note = Description of Unknown:uncultivated organism with predicted taxonomy: Bacteroides sp.CAG:770
  REGION 1..160: note = MG16-91 HNH domain

SEQ ID NO: 4813 - protein, 160 aa, unidentified; identical to SEQ ID NO: 4756
  REGION 1..160: note = Description of Unknown:uncultivated organism with predicted taxonomy: Alistipes sp.CAG:514
  REGION 1..160: note = MG16-92 HNH domain

SEQ ID NO: 4814 - protein, 160 aa, unidentified; identical to SEQ ID NO: 4756
  REGION 1..160: note = Description of Unknown:uncultivated organism with predicted taxonomy: Alistipes sp.CAG:514
  REGION 1..160: note = MG16-93 HNH domain

SEQ ID NO: 4815 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-94 HNH domain

SEQ ID NO: 4816 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-95 HNH domain

SEQ ID NO: 4817 - protein, 160 aa, unidentified; identical to SEQ ID NO: 4741
  REGION 1..160: note = Description of Unknown:uncultivated organism with predicted taxonomy: Bacteroides
  REGION 1..160: note = MG16-96 HNH domain

SEQ ID NO: 4818 - protein, 160 aa, unidentified
  REGION 1..160: note = Description of Unknown:uncultivated organism with predicted taxonomy: Bacteroides
  REGION 1..160: note = MG16-97 HNH domain
ELKLSKEGRAATAKNIRNREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4819 - protein, 160 aa, unidentified
  REGION 1..160: note = Description of Unknown:uncultivated organism with predicted taxonomy: Bacteroides sp.CAG:770
  REGION 1..160: note = MG16-98 HNH domain
ELKLSKEGRESAAKNIRAREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4820 - protein, 160 aa, unidentified
  REGION 1..160: note = Description of Unknown:uncultivated organism with predicted taxonomy: Bacteroides sp.CAG:709
  REGION 1..160: note = MG16-99 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRDSTAYDYMKSKGENAFNDYLRRVDTAFSEHKISFTKRSRLLTPADKIPKDFISRQL

SEQ ID NO: 4821 - protein, 160 aa, unidentified
  REGION 1..160: note = Description of Unknown:uncultivated organism with predicted taxonomy: Bacteroides sp.CAG:709
  REGION 1..160: note = MG16-100 HNH domain
ELKLSKEGRAATAKNIRDREKENKEIAEKIIELDVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4822 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-101 HNH domain

SEQ ID NO: 4823 - protein, 160 aa, unidentified
  REGION 1..160: note = Description of Unknown:uncultivated organism with predicted taxonomy: Bacteroides sp.CAG:770
  REGION 1..160: note = MG16-102 HNH domain
ELKLSKAGRESAANNIRTRKKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4824 - protein, 160 aa, unidentified; identical to SEQ ID NO: 4767
  REGION 1..160: note = Description of Unknown:uncultivated organism with predicted taxonomy: Bacteroides sp.CAG:770
  REGION 1..160: note = MG16-103 HNH domain

SEQ ID NO: 4825 - protein, 160 aa, unidentified; identical to SEQ ID NO: 4754
  REGION 1..160: note = Description of Unknown:uncultivated organism with predicted taxonomy: Bacteroides
  REGION 1..160: note = MG16-104 HNH domain

SEQ ID NO: 4826 - protein, 160 aa, unidentified
  REGION 1..160: note = Description of Unknown:uncultivated organism with predicted taxonomy: Bacteroides sp.CAG:770
  REGION 1..160: note = MG16-105 HNH domain
ELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFIARQL

SEQ ID NO: 4827 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-106 HNH domain

SEQ ID NO: 4828 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-107 HNH domain

SEQ ID NO: 4829 - protein, 160 aa, unidentified; identical to SEQ ID NO: 4746
  REGION 1..160: note = Description of Unknown:uncultivated organism with predicted taxonomy: Bacteroides sp.CAG:770
  REGION 1..160: note = MG16-108 HNH domain

SEQ ID NO: 4830 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-109 HNH domain

SEQ ID NO: 4831 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-110 HNH domain

SEQ ID NO: 4832 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-113 HNH domain

SEQ ID NO: 4833 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-114 HNH domain

SEQ ID NO: 4834 - protein, 160 aa, unidentified; identical to SEQ ID NO: 4747
  REGION 1..160: note = Description of Unknown:uncultivated organism with predicted taxonomy: Bacteroides sp.CAG:770
  REGION 1..160: note = MG16-115 HNH domain

SEQ ID NO: 4835 - protein, 160 aa, unidentified; identical to SEQ ID NO: 4741
  REGION 1..160: note = Description of Unknown:uncultivated organism with predicted taxonomy: Bacteroides
  REGION 1..160: note = MG16-116 HNH domain

SEQ ID NO: 4836 - protein, 160 aa, unidentified; identical to SEQ ID NO: 4787
  REGION 1..160: note = Description of Unknown:uncultivated organism with predicted taxonomy: Bacteroides sp.CAG:770
  REGION 1..160: note = MG16-118 HNH domain

SEQ ID NO: 4837 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-119 HNH domain

SEQ ID NO: 4838 - protein, 160 aa, unidentified; identical to SEQ ID NO: 4770
  REGION 1..160: note = Description of Unknown:uncultivated organism with predicted taxonomy: Bacteroides sp.CAG:709
  REGION 1..160: note = MG16-120 HNH domain

SEQ ID NO: 4839 - protein, 160 aa, unidentified
  REGION 1..160: note = Description of Unknown:uncultivated organism with predicted taxonomy: Bacteroides sp.CAG:770
  REGION 1..160: note = MG16-121 HNH domain
ELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGHGENAFEDYLKRVETAFKENRISQTKRNRLLTPADKIPKDFISRQL

SEQ ID NO: 4840 - protein, 160 aa, unidentified
  REGION 1..160: note = Description of Unknown:uncultivated organism with predicted taxonomy: Bacteroides sp.CAG:770
  REGION 1..160: note = MG16-122 HNH domain
ELKLSKAGRESAAKNIRTREKANEEIAKRIEELGLVPSKNKILKYRLWEEFGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFISRQL

SEQ ID NO: 4841 - protein, 160 aa, unidentified; identical to SEQ ID NO: 4747
  REGION 1..160: note = Description of Unknown:uncultivated organism with predicted taxonomy: Bacteroides sp.CAG:545
  REGION 1..160: note = MG16-123 HNH domain

SEQ ID NO: 4842 - protein, 160 aa, unidentified
  REGION 1..160: note = Description of Unknown:uncultivated organism with predicted taxonomy: Bacteroides sp.CAG:770
  REGION 1..160: note = MG16-126 HNH domain
ELKLSKEGRAATAKNIRDREKMNNEMAEKIKELGITPSKNKILKYRLWQESGQKCFYCGQPVGAAEFLCGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4843 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-127 HNH domain

SEQ ID NO: 4844 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-128 HNH domain

SEQ ID NO: 4845 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-129 HNH domain

SEQ ID NO: 4846 - protein, 160 aa, unidentified
  REGION 1..160: note = Description of Unknown:uncultivated organism with predicted taxonomy: Bacteroides sp.CAG:770
  REGION 1..160: note = MG16-130 HNH domain
ELKLSKAGRESAANNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4847 - protein, 160 aa, unidentified
  REGION 1..160: note = Description of Unknown:uncultivated organism with predicted taxonomy: Bacteroides sp.CAG:709
  REGION 1..160: note = MG16-131 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFVSRQL

SEQ ID NO: 4848 - protein, 160 aa, unidentified; identical to SEQ ID NO: 4741
  REGION 1..160: note = Description of Unknown:uncultivated organism with predicted taxonomy: Bacteroides
  REGION 1..160: note = MG16-132 HNH domain

SEQ ID NO: 4849 - protein, 174 aa, unidentified
  REGION 1..174: note = Description of Unknown:uncultivated organism with predicted taxonomy: Bacteroidales
  REGION 1..174: note = MG16-133 HNH domain
ELKQSKEEREKTDRGIRKQQKANEVFANLLKEQGVRPTRNRILKYRLWRESYETCFYCGQPISFKEFLKFSDVEREHVIPKRLLYDDSFANQVCSCRKCNAEKGGRTAIDYMRTTQHLQPYLEKVDKMFQEHKISGKKHAHLLASYDDYLSRKKEGKETKDDIIIWEEAIERQL

SEQ ID NO: 4850 - protein, 197 aa, unidentified
  REGION 1..197: note = Description of Unknown:uncultivated organism
  REGION 1..197: note = MG16-134 HNH domain
ELKQSKDDRNTTYLQNEAMERLNDAIAKRLNSEGIKTTKRILEKYKYIFPTKGCIDKKTGKFVSKNFENLSTVNQCIYCGKSFSLTAALNGDGYEVEHIIPRDLICDNSQSNKVLSCRSCNSKKSNKTAFDFMRGQGEQALEDYIARIEKWYKDGIISPAKREHLLLSHEDYLKRKKEGKTTDEDKKYWEDFVSRQA

SEQ ID NO: 4851 - protein, 197 aa, unidentified
  REGION 1..197: note = Description of Unknown:uncultivated organism with predicted taxonomy: Porphyromonassp. oral taxon 278
  REGION 1..197: note = MG16-135 HNH domain
ELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKRKDKATDIDKKYWEDFVSRQA

SEQ ID NO: 4852 - protein, 160 aa, unidentified
  REGION 1..160: note = Description of Unknown:uncultivated organism with predicted taxonomy: Bacteroidales
  REGION 1..160: note = MG16-136 HNH domain
ELKQSRDERNDAYLSINKRERENKVIEERIREYGISPSKSRIQKYRLWEESNHLCFYCGHPVGAAEFLSGSGVEIEHIIPRSLLFDDSFANKVCACRQCNAEKGNSTAFDYMKSKPANDFEDYLKRVEKYFTEKRISKTKRERLLTPASEIPQDFIDRQL

SEQ ID NO: 4853 - protein, 174 aa, unidentified
  REGION 1..174: note = Description of Unknown:uncultivated organism with predicted taxonomy: Prevotella
  REGION 1..174: note = MG16-137 HNH domain
ELKQSKDERNETEIGIRKQQKLNDEYAKILKEEGVRPTRNRILKYRLWRESNKSCFYCEQPISFHEFLDFSETEREHIIPKKLMYDDSFANQVCSCRNCNKEKGGRTAMDYMRTKQNLQFYLDKVDKMFQDHKISGKKRSHLLASYDDYLFRKENGKETKDDILIWEKPIERQL

SEQ ID NO: 4854 - protein, 160 aa, unidentified
  REGION 1..160: note = Description of Unknown:uncultivated organism
  REGION 1..160: note = MG16-138 HNH domain
ELKQSRDERNSAFLNNNKRERDNKAISERIQEMGIRASRSRILKYRLWEEAKHICFYCGQTVGVKEFLEGTDVEIEHIIPRSLFFDDSFSNKVCACRKCNAEKGNRTAYDYMKQKSDNDFADYTRRIEDAYEKKEISKTKRERLLTTAKDIPEDFIDRQL

SEQ ID NO: 4855 - protein, 161 aa, unidentified
  REGION 1..161: note = Description of Unknown:uncultivated organism with predicted taxonomy: Bacteroidales
  REGION 1..161: note = MG16-139 HNH domain
ELKQSRDERESAYKAINKNERENSTIANRILEDYGIRPSRSRIQKYRMWEESKQRCFYCGKMIDVKQFLSGADVEIEHIVPRSILFDDSYSNKVCACRECNQEKGNLTAMEYMEGKPTGEFEAYKQRVDEAFSEHRISKTKRDHLLWRRADIPQDFIERQL

SEQ ID NO: 4856 - protein, 160 aa, unidentified
  REGION 1..160: note = Description of Unknown:uncultivated organism with predicted taxonomy: Fibrobacter
  REGION 1..160: note = MG16-140 HNH domain
ELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQL

SEQ ID NO: 4857 - protein, 160 aa, unidentified
  REGION 1..160: note = Description of Unknown:uncultivated organism with predicted taxonomy: Bacteroidales
  REGION 1..160: note = MG16-141 HNH domain
ELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPAAEVEAYKQRVDEAFKEGRISKTKRDHLLWHKSDIPTDFIDRQL

SEQ ID NO: 4858 - protein, 160 aa, unidentified
  REGION 1..160: note = Description of Unknown:uncultivated organism with predicted taxonomy: Bacteroidales
  REGION 1..160: note = MG16-142 HNH domain
ELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQL

SEQ ID NO: 4859 - protein, 160 aa, unidentified
  REGION 1..160: note = Description of Unknown:uncultivated organism with predicted taxonomy: Deminuibactersoli
  REGION 1..160: note = MG16-143 HNH domain
ELKQSRDERNDAFLKNNKRERENKVIEERIREYGITPSRSRIQKYRLWEESNHLCFYCGQPVGAAEFLSGSGVEIEHIIPRSLLFDDSYANKVCSCRKCNAEKGNSTAYDYMKAKPEGDFEDYLKRIEKFFSEKRISKSKREKLLTPASEIPQDFIDRQL

SEQ ID NO: 4860 - protein, 197 aa, unidentified
  REGION 1..197: note = Description of Unknown:uncultivated organism with predicted taxonomy: Bacteroidales
  REGION 1..197: note = MG16-144 HNH domain
ELKQSKDERNTTFLQNEAMQRLNESIAKRLVSENINPTKRIIDKYKFIFPTKGCFDKRTGKFITKNFESLSTVNRCIYCGQSFSLSEALNGDGYEIEHILPRDLICDNSQNNKVLSCRKCNSIKSNKTAFDYMRTQDKNAFEAYLERVESWYKDGIISPAKRERLLLSHEDYLERKRIGKETDEDKKYWEEFVSRQA

SEQ ID NO: 4861 - protein, 197 aa, unidentified
  REGION 1..197: note = Description of Unknown:uncultivated organism with predicted taxonomy: Bacteroides
  REGION 1..197: note = MG16-145 HNH domain
ELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQA

SEQ ID NO: 4862 - protein, 160 aa, unidentified
  REGION 1..160: note = Description of Unknown:uncultivated organism with predicted taxonomy: Bacteroidetes
  REGION 1..160: note = MG16-146 HNH domain
ELKQSKDERNSTFLNNNKRERENKIIEERIAEMGIRPSRSRILKYRLWEEAKHICFYCGQPVGVKEFLEGAEVEIEHIIPRSLFFDDSFANKVCSCRKCNAEKGNRTAFDYMKQKGENEFSDYSRRIEEAFEKKEISKVKRERLLTSAKDIPEDFIDRQL

SEQ ID NO: 4863 - protein, 160 aa, unidentified
  REGION 1..160: note = Description of Unknown:uncultivated organism with predicted taxonomy: Bacteroidales
  REGION 1..160: note = MG16-147 HNH domain
ELKQSREERESAYRAMGQNERRNKEIAEKISEFGIRPSRSRIQKYKMWEESMHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPADFIERQL

SEQ ID NO: 4864 - protein, 160 aa, unidentified
  REGION 1..160: note = Description of Unknown:uncultivated organism with predicted taxonomy: Bacteroidales
  REGION 1..160: note = MG16-148 HNH domain
ELKQSRDERESAYKAMGQNERRNKEIAAKITEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPSDFIERQL

SEQ ID NO: 4865 - protein, 197 aa, unidentified
  REGION 1..197: note = Description of Unknown:uncultivated organism with predicted taxonomy: Bacteroidetes
  REGION 1..197: note = MG16-149 HNH domain
ELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKKKGKITDIDKKYWEDFVSRQA

SEQ ID NO: 4866 - protein, 174 aa, unidentified
  REGION 1..174: note = Description of Unknown:uncultivated organism with predicted taxonomy: Bacteroidales
  REGION 1..174: note = MG16-150 HNH domain
ELKQSKTEREEASAGIRKQQALNDNYANILKSESIRPTRNKILKYRLWTESNKTCFYCDQPVNFKEYLQTTEFEREHVIPKRLIFDDSFANQVCSCSKCNKEKGGLTALDFMRTKANLRNYLDKVDSMYQKHEISGKKRSHLLASYDDYLERKKEGKETKEDIMIWETPIDRQL

SEQ ID NO: 4867 - protein, 197 aa, unidentified; identical to SEQ ID NO: 4861
  REGION 1..197: note = Description of Unknown:uncultivated organism with predicted taxonomy: Prevotella
  REGION 1..197: note = MG16-151 HNH domain

SEQ ID NO: 4868 - protein, 161 aa, unidentified
  REGION 1..161: note = Description of Unknown:uncultivated organism with predicted taxonomy: Fibrobacter
  REGION 1..161: note = MG16-152 HNH domain
ELKQSKDERNTTFNNIAKRERENKGIAERIKNEYGLIPNRNKIEKYRLWEEAEQKCFYCGQTVNVKEFLSGFDVEVEHVIPKSLLFDDSYANKVCACRKCNANKGNKTAFDFMKSQSEDAFNNYVSRVEEYYKNGKISRTKHDRLLTPQSEIPSDFIERQL

SEQ ID NO: 4869 - protein, 160 aa, unidentified
  REGION 1..160: note = Description of Unknown:uncultivated organism with predicted taxonomy: Bacteroidales
  REGION 1..160: note = MG16-153 HNH domain
ELKQSREEREGAYRRNNQNERLNKEIIAKIEEMGIRPSRSRIQKYKMWEENNHRCMYCGKTVSLAEFLNGADVEIEHIIPRSILFDDSFSNKVCACRECNHEKGNMTALDYIETKPAAEQEAYKQRVDEAFKEGRISKTKRDHLLWHRSEIPTDFIERQL

SEQ ID NO: 4870 - protein, 160 aa, unidentified
  REGION 1..160: note = Description of Unknown:uncultivated organism with predicted taxonomy: Bacteroidales
  REGION 1..160: note = MG16-154 HNH domain
ELKQSRDERESAYKAMGQNERRNKEIAAKIAEFGIRPSRSRIQKYKMWEESQHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQL

SEQ ID NO: 4871 - protein, 160 aa, unidentified
  REGION 1..160: note = Description of Unknown:uncultivated organism with predicted taxonomy: Bacteroidales
  REGION 1..160: note = MG16-155 HNH domain
ELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQL

SEQ ID NO: 4872 - protein, 160 aa, unidentified
  REGION 1..160: note = Description of Unknown:uncultivated organism with predicted taxonomy: Bacteroidales
  REGION 1..160: note = MG16-156 HNH domain
ELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQL

SEQ ID NO: 4873 - protein, 160 aa, unidentified
  REGION 1..160: note = Description of Unknown:uncultivated organism with predicted taxonomy: Fibrobacter
  REGION 1..160: note = MG16-157 HNH domain
ELKQSKDERKATAANIAKRERENKAIAAKIEEFGIRPSRNRIQKYRLWEESEQKCFYCGQPVDAREFLSGLDVEVEHIIPKSLLFDDSFANKVCACRKCNAAKGNRTAFDYMKSQSSNAFDAYIKRVNDFYKDGKISKTKNERLLTTQSEIPSDFIERQL

SEQ ID NO: 4874 - protein, 160 aa, unidentified
  REGION 1..160: note = Description of Unknown:uncultivated organism with predicted taxonomy: Bacteroidetes
  REGION 1..160: note = MG16-158 HNH domain
ELKQSRDERNNAFLNNNKRERENKVLEERIREYGISPSRSRIQKYRLWEESNHLCFYCGQPVGAAEFLSGSGVEIEHIIPRSLLFDDSYANKVCSCRKCNAEKGNSTAYDYMKAKPEGDFEDYLKRIETFFSEKRISKAKRDKLLTPATDIPQDFIDRQL

SEQ ID NO: 4875 - protein, 177 aa, unidentified
  REGION 1..177: note = Description of Unknown:uncultivated organism with predicted taxonomy: Bacteroidetes
  REGION 1..177: note = MG16-159 HNH domain
ELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQL

SEQ ID NO: 4876 - protein, 160 aa, unidentified
  REGION 1..160: note = Description of Unknown:uncultivated organism with predicted taxonomy: Fibrobacter
  REGION 1..160: note = MG16-160 HNH domain
ELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQL

SEQ ID NO: 4877 - protein, 160 aa, unidentified
  REGION 1..160: note = Description of Unknown:uncultivated organism with predicted taxonomy: Bacteroidales
  REGION 1..160: note = MG16-161 HNH domain
ELKQSREERENAYKRNNQNERLNKEIAAKIEEMGIRPSRSRIQKYKMWEESDHRCMYCGKMVSLAEFLNGADVEIEHIIPRSILFDDSYSNKVCACRDCNREKDNLTALDYLETKTGAELEAYKQRVDDAFKEGRISKTKRDHLLWRREDIPSDFIERQL

SEQ ID NO: 4878 - protein, 177 aa, unidentified
  REGION 1..177: note = Description of Unknown:uncultivated organism with predicted taxonomy: Prevotella
  REGION 1..177: note = MG16-162 HNH domain
ELKQSKDERNEAFKRNNQNEKKNKEYAEHIKEYQLTPTRNRLLKWKLYEESDHACMYCGQPIKVREFLQGADVEREHIIPKGLLFDNSFTNQVCSCRSCNSKKGMRTAYDFIEAEKGEEGLRSYIEHINYLFDKKNISRSKYNRLLVSYKAYLQRKVQGKETEEDKNLWENFIDRQL

SEQ ID NO: 4879 - protein, 197 aa, unidentified; identical to SEQ ID NO: 4861
  REGION 1..197: note = Description of Unknown:uncultivated organism with predicted taxonomy: Bacteroides
  REGION 1..197: note = MG16-163 HNH domain

SEQ ID NO: 4880 - protein, 177 aa, unidentified
  REGION 1..177: note = Description of Unknown:uncultivated organism with predicted taxonomy: Prevotella
  REGION 1..177: note = MG16-164 HNH domain
ELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQL

SEQ ID NO: 4881 - protein, 160 aa, unidentified
  REGION 1..160: note = Description of Unknown:uncultivated organism
  REGION 1..160: note = MG16-165 HNH domain
ELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPATEVEAYKQRVDEAFKEGQISKTKRDHLLWHRSDIPTDFIDRQL

SEQ ID NO: 4882 - protein, 177 aa, unidentified
  REGION 1..177: note = Description of Unknown:uncultivated organism with predicted taxonomy: Bacteroidales
  REGION 1..177: note = MG16-166 HNH domain
ELKQNREERNEAFKRNAQNEKLNKEYAERIKEYGLTPTRNRIMKMKMWEESENTCMYCGQPVDVVEFLQGADVEREHIIPRGLLFDNSFTNQVCSCRKCNSQKGMRTAYDFIEDEKGQEGLESYIKHINYLFDKKKINRSKLNRLLVSHKAYINRKSLGKETEEDKQLWENFIDRQL

SEQ ID NO: 4883 - protein, 160 aa, unidentified
  REGION 1..160: note = Description of Unknown:uncultivated organism with predicted taxonomy: Bacteroidales
  REGION 1..160: note = MG16-167 HNH domain
ELKQSRDERESAYKAMGQNERRNKEIAAKIAEFGIRSSRSRIQKYKMWEESLHQCFYCGKTIDLSEFLNGADVEIEHIIPRSILFDDSFSNKVCACRRCNQEKGNQTAMEYMETKSASEQEAYKQRVDEAFTTKRISLTKRDHLLWHKADIPSDFIDRQE

SEQ ID NO: 4884 - protein, 174 aa, unidentified
  REGION 1..174: note = Description of Unknown:uncultivated organism with predicted taxonomy: Barnesiellaviscericola
  REGION 1..174: note = MG16-168 HNH domain
ELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQL

SEQ ID NO: 4885 - protein, 160 aa, unidentified; identical to SEQ ID NO: 4858
  REGION 1..160: note = Description of Unknown:uncultivated organism with predicted taxonomy: Bacteroidales
  REGION 1..160: note = MG16-169 HNH domain

SEQ ID NO: 4886 - protein, 160 aa, unidentified; identical to SEQ ID NO: 4854
  REGION 1..160: note = Description of Unknown:uncultivated organism
  REGION 1..160: note = MG16-170 HNH domain

SEQ ID NO: 4887 - protein, 160 aa, unidentified; identical to SEQ ID NO: 4877
  REGION 1..160: note = Description of Unknown:uncultivated organism with predicted taxonomy: Bacteroidales
  REGION 1..160: note = MG16-171 HNH domain

SEQ ID NO: 4888 - protein, 160 aa, unidentified
  REGION 1..160: note = Description of Unknown:uncultivated organism with predicted taxonomy: Prevotellabrevis
  REGION 1..160: note = MG16-172 HNH domain
ELKQSREEREGAYRRNNQNERLNKEIAAKIEEMGIRPSRSRIQKYKMWEETNHRCMYCGKTVSLAEFLNGADVEIEHIIPRSILFDDSFSNKVCACRECNHEKGNMTALDYIETKPAAEVEAYKQRVDEAFKEGQISKTKRDHLLWHKSDIPTDFIDRQL

SEQ ID NO: 4889 - protein, 197 aa, unidentified; identical to SEQ ID NO: 4861
  REGION 1..197: note = Description of Unknown:uncultivated organism with predicted taxonomy: Bacteroides
  REGION 1..197: note = MG16-173 HNH domain

SEQ ID NO: 4890 - protein, 160 aa, unidentified
  REGION 1..160: note = Description of Unknown:uncultivated organism with predicted taxonomy: Bacteroidetes
  REGION 1..160: note = MG16-174 HNH domain
ELKQSRDERESAYKAMGKNERRNKEIAEKIAEFGIRPSRSRIQKYKMWEESMHQCFYCGKTIDLAEFLNGADVEIEHIIPRSILFDDSFSNKVCACRRCNQEKSNQTAMEYMETKPVGELEAYKRRVDEAFTAKRISKTKRDHLLWRKADIPTDFIERQL

SEQ ID NO: 4891 - protein, 174 aa, unidentified; identical to SEQ ID NO: 4884
  REGION 1..174: note = Description of Unknown:uncultivated organism with predicted taxonomy: Prevotella
  REGION 1..174: note = MG16-175 HNH domain

SEQ ID NO: 4892 - protein, 160 aa, unidentified
  REGION 1..160: note = Description of Unknown:uncultivated organism with predicted taxonomy: Bacteroidales
  REGION 1..160: note = MG16-176 HNH domain
ELKQSRDERESAYKAMGQNERRNKEIAAKIAEFGIRPSRSRIQKYKMWEESLHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQL

SEQ ID NO: 4893 - protein, 160 aa, unidentified; identical to SEQ ID NO: 4869
  REGION 1..160: note = Description of Unknown:uncultivated organism with predicted taxonomy: Bacteroidia
  REGION 1..160: note = MG16-177 HNH domain

SEQ ID NO: 4894 - protein, 160 aa, unidentified; identical to SEQ ID NO: 4872
  REGION 1..160: note = Description of Unknown:uncultivated organism with predicted taxonomy: Porphyromonassp. oral taxon 278
  REGION 1..160: note = MG16-178 HNH domain

SEQ ID NO: 4895 - protein, 160 aa, unidentified; identical to SEQ ID NO: 4854
  REGION 1..160: note = Description of Unknown:uncultivated organism
  REGION 1..160: note = MG16-179 HNH domain

SEQ ID NO: 4896 - protein, 160 aa, unidentified
  REGION 1..160: note = Description of Unknown:uncultivated organism with predicted taxonomy: Bacteroidales
  REGION 1..160: note = MG16-180 HNH domain
ELKQSREERENAFKRNNQNERLNKEIADKIEEMGIRPSRSRIQKYKMWEESNHRCMYCGKTVSLAEFLNGADVEIEHIIPRSILFDDSFSNKVCACRECNHEKDNMTALDYLETKPAVEVDAYKQRVDEAFKEGRISKTKRDHLLWHKSDIPQDFIDRQL

SEQ ID NO: 4897 - protein, 160 aa, unidentified; identical to SEQ ID NO: 4872
  REGION 1..160: note = Description of Unknown:uncultivated organism with predicted taxonomy: Bacteroidales
  REGION 1..160: note = MG16-181 HNH domain

SEQ ID NO: 4898 - protein, 177 aa, unidentified; identical to SEQ ID NO: 4875
  REGION 1..177: note = Description of Unknown:uncultivated organism with predicted taxonomy: Prevotella
  REGION 1..177: note = MG16-182 HNH domain

SEQ ID NO: 4899 - protein, 177 aa, unidentified
  REGION 1..177: note = Description of Unknown:uncultivated organism with predicted taxonomy: Prevotella
  REGION 1..177: note = MG16-183 HNH domain
ELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMNRKAQGKETEEDKELWENFIDRHL

SEQ ID NO: 4900 - protein, 160 aa, unidentified; identical to SEQ ID NO: 4872
  REGION 1..160: note = Description of Unknown:uncultivated organism with predicted taxonomy: Bacteroidales
  REGION 1..160: note = MG16-184 HNH domain

SEQ ID NO: 4901 - protein, 160 aa, unidentified; identical to SEQ ID NO: 4876
  REGION 1..160: note = Description of Unknown:uncultivated organism with predicted taxonomy: Fibrobacter
  REGION 1..160: note = MG16-185 HNH domain

SEQ ID NO: 4902 - protein, 177 aa, unidentified; identical to SEQ ID NO: 4880
  REGION 1..177: note = Description of Unknown:uncultivated organism with predicted taxonomy: Prevotella
  REGION 1..177: note = MG16-186 HNH domain

SEQ ID NO: 4903 - protein, 160 aa, unidentified
  REGION 1..160: note = Description of Unknown:uncultivated organism with predicted taxonomy: Bacteroidales
  REGION 1..160: note = MG16-187 HNH domain
ELKQSRDERESAYRAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQL

SEQ ID NO: 4904 - protein, 177 aa, unidentified
  REGION 1..177: note = Description of Unknown:uncultivated organism
  REGION 1..177: note = MG16-188 HNH domain
ELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQL

SEQ ID NO: 4905 - protein, 177 aa, unidentified; identical to SEQ ID NO: 4904
  REGION 1..177: note = Description of Unknown:uncultivated organism
  REGION 1..177: note = MG16-189 HNH domain

SEQ ID NO: 4906 - protein, 177 aa, unidentified
  REGION 1..177: note = Description of Unknown:uncultivated organism with predicted taxonomy: Prevotellaruminicola
  REGION 1..177: note = MG16-190 HNH domain
ELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMSRKAQGKETDEDKELWENFIDRQL

SEQ ID NO: 4907 - protein, 160 aa, unidentified
  REGION 1..160: note = Description of Unknown:uncultivated organism with predicted taxonomy: Labilibaculumfiliforme
  REGION 1..160: note = MG16-191 HNH domain
ELKQSRDERESAYKAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQL

SEQ ID NO: 4908 - protein, 177 aa, unidentified
  REGION 1..177: note = Description of Unknown:uncultivated organism with predicted taxonomy: Bacteroidales
  REGION 1..177: note = MG16-192 HNH domain
ELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQL

SEQ ID NO: 4909 - protein, 160 aa, unidentified
  REGION 1..160: note = Description of Unknown:uncultivated organism
  REGION 1..160: note = MG16-193 HNH domain
ELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQL

SEQ ID NO: 4910 - protein, 177 aa, unidentified
  REGION 1..177: note = Description of Unknown:uncultivated organism with predicted taxonomy:Sediminibacterium sp. C3
  REGION 1..177: note = MG16-194 HNH domain
ELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWDNFIDRQL

SEQ ID NO: 4911 - protein, 175 aa, unidentified
  REGION 1..175: note = Description of Unknown:uncultivated organism with predicted taxonomy: Bacteroides
  REGION 1..175: note = MG16-195 HNH domain
ELKQSKDERHDTSEVIKALENKNKEYKTFIEKEYKLKATRKNLLRYRLWIESNQSCFYCLKPIKFTPFANESEEEREHILPKALHYDDSFANQVCSCKDCNSTKGGRTAMDYMRTTPYLQHYIDRVNKLYQANKISGKKYSHLLASYDDYQLRKKEGKETKEDILIWEKPIDRQL

SEQ ID NO: 4912 - protein, 177 aa, unidentified
  REGION 1..177: note = Description of Unknown:uncultivated organism with predicted taxonomy:Gammaproteobacteria bacterium
  REGION 1..177: note = MG16-196 HNH domain
ELKQSKDERNEAFKRNSQNERENKEYAERIKEYGLTPTRNRIMKMRMWEESEYTCMYCGQPVNVVEFLKGADVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQL

SEQ ID NO: 4913 - protein, 174 aa, unidentified
  REGION 1..174: note = Description of Unknown:uncultivated organism with predicted taxonomy: Bacteroides
  REGION 1..174: note = MG16-197 HNH domain
ELKQSKDERKEASDGIRKQQKRNEEYAKMLVEEGVRPTRNRILRYRLWEESNKRCFYCGQPISFNEFIKSSDAEREHVIPKALMFDDSFANQVCSCRECNKEKGGRTALDYMRTKSNLQAYLDRVDDMYQSHQIGGKKHSHLLASYDDYLSRKKEGKETKEDIMIWETPIERQL

SEQ ID NO: 4914 - protein, 177 aa, unidentified
  REGION 1..177: note = Description of Unknown:uncultivated organism with predicted taxonomy: Bacteroidales
  REGION 1..177: note = MG16-198 HNH domain
ELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYINRKALGKETDEDKELWENFIDRQL

SEQ ID NO: 4915 - protein, 177 aa, unidentified; identical to SEQ ID NO: 4908
  REGION 1..177: note = Description of Unknown:uncultivated organism with predicted taxonomy:Gammaproteobacteria bacterium
  REGION 1..177: note = MG16-199 HNH domain

SEQ ID NO: 4916 - protein, 160 aa, unidentified
  REGION 1..160: note = Description of Unknown:uncultivated organism with predicted taxonomy: Fibrobacter
  REGION 1..160: note = MG16-200 HNH domain
ELKQSKDERNTTASNIAKKERENKNIEAKIQEFGIRSSRNRIQKYRLWEESEQKCFYCGQPVQAKEFLSGLDVEVEHIIPKSLLFDDSFANKVCACRKCNADKGNKTAYDFMKGQKTEVFDAYVKRVNDFYKDGKISKTKKERLLTTQSEIPSDFIERQL

SEQ ID NO: 4917 - protein, 197 aa, unidentified
  REGION 1..197: note = Description of Unknown:uncultivated organism with predicted taxonomy: Prevotella
  REGION 1..197: note = MG16-201 HNH domain
ELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQA

SEQ ID NO: 4918 - protein, 161 aa, unidentified
  REGION 1..161: note = Description of Unknown:uncultivated organism
  REGION 1..161: note = MG16-202 HNH domain
ELKQSRDERESAYKAMGQNERRNKEIAAKIAEFGIRPSRSRIQKYKMWEESQHRCFYCGEMMDLTQFLNGADVEIEHIIPRSILFDDSYSNKVCACRRCNQEKGNMTAMEYMEAKPSAEFEAYKQRVDDVFNKDHRISKTKRDHLLWRRADIPQDFIDRQL

SEQ ID NO: 4919 - protein, 174 aa, unidentified
  REGION 1..174: note = Description of Unknown:uncultivated organism with predicted taxonomy: Bacteroides sp.CAG:144
  REGION 1..174: note = MG16-203 HNH domain
ELKQSKEERDETSKGISKQQKLNDEYANLLKESGIRPTRNKITRYRLWREANETCFYCGQPVNFNEFVKFSEAEREHIIPKSLILDDSFANQVCSCRKCNAEKGGRTAIDYMRTTPYLQAYLTKVDEMFQGHKISGKKHAHLLASYEDYLVRKQQGKETKEDVNIWEAPIDRQL

SEQ ID NO: 4920 - protein, 177 aa, unidentified
  REGION 1..177: note = Description of Unknown:uncultivated organism with predicted taxonomy: Bacteroidales
  REGION 1..177: note = MG16-204 HNH domain
ELKQSKDERNEAFRRNNQNERLNKELAERIKKYGLTPTRNRIMKLKMWEESEHSCMYCKQPVDPVEFLKGADVEREHIIPRALLFDNSFTNQVCSCRRCNSKKGMRTAYDFIADEKGQEGLNAYIEHINDLFDKKKISRSKLNRLLVSHKAYISRKAQGKETDEDKELWENFIDRQL

SEQ ID NO: 4921 - protein, 160 aa, unidentified; identical to SEQ ID NO: 4916
  REGION 1..160: note = Description of Unknown:uncultivated organism with predicted taxonomy: Fibrobacter
  REGION 1..160: note = MG16-205 HNH domain

SEQ ID NO: 4922 - protein, 177 aa, unidentified; identical to SEQ ID NO: 4908
  REGION 1..177: note = Description of Unknown:uncultivated organism with predicted taxonomy:Gammaproteobacteria bacterium
  REGION 1..177: note = MG16-206 HNH domain

SEQ ID NO: 4923 - protein, 174 aa, unidentified
  REGION 1..174: note = Description of Unknown:uncultivated organism
  REGION 1..174: note = MG16-207 HNH domain
ELKQSKEERDETSKGISKQQKLNDEYANLLKGKGIRPTRNKITRYRLLMESNETCFYCGQPVNFNEFVKFSEAEREHIIPKSLILDDSFANQVCSCRKCNAEKGGRTAIDYMRTTPHLQAFLSKVDEMFQGHKISGKKHAHLLASYEDYLVRKKQGKETKEDVNIWETPIDRQL

SEQ ID NO: 4924 - protein, 174 aa, unidentified
  REGION 1..174: note = Description of Unknown:uncultivated organism
  REGION 1..174: note = MG16-208 HNH domain
ELKQSKDEREKTSKDIRANKKKNDECAERVKEYGFSPTRNRIMRYKMWVETNHRCIYCNDGVNVKDFLSGVDVEREHIIPKALLFDDSFSNQTCSCRKCNRDKGSRTALDYIRDCGREEEYITRVNELLEKRQISKTKYNHLLTSYRDYLERKTQGKETQEDKDLWEHFIDRQL

SEQ ID NO: 4925 - protein, 197 aa, unidentified; identical to SEQ ID NO: 4917
  REGION 1..197: note = Description of Unknown:uncultivated organism with predicted taxonomy:Chryseobacterium vrystaatense
  REGION 1..197: note = MG16-209 HNH domain

SEQ ID NO: 4926 - protein, 160 aa, unidentified
  REGION 1..160: note = Description of Unknown:uncultivated organism
  REGION 1..160: note = MG16-210 HNH domain
ELKQSKDERNEVFLRNNKRERENAEIIKRIEEYGVRPSRSRIQKYRLWEESNQICFYCGNTVGVKEFLSGVDAEIEHIIPRSLFFDDSFSNKVCACRACNQEKGNRTAYDYMQSKSEIEFDNYLRRVENYYNEKKISKTKRERLLTAAKDIPQDFLDRQL

SEQ ID NO: 4927 - protein, 197 aa, unidentified
  REGION 1..197: note = Description of Unknown:uncultivated organism with predicted taxonomy: Prevotella
  REGION 1..197: note = MG16-211 HNH domain
ELKQSKDERNTTFLQNEAMQRLNESIAKRLSFEDIKPTKRTIEKYKFIFPTKGCIDKRTGKFVTKSFDGLSTINQCIYCGQPFSLSAALNGDGYEIEHIIPRDLLCDNSQNNKVLSCRKCNSRKSNKTAFDFMRSQDESIFEEYLERIELWYKNGIISPTKREHLLLSHEDYLERKKKGKVTDIDKKYWEDFVSRQV

SEQ ID NO: 4928 - protein, 177 aa, unidentified; identical to SEQ ID NO: 4878
  REGION 1..177: note = Description of Unknown:uncultivated organism with predicted taxonomy: Prevotellaihumii
  REGION 1..177: note = MG16-212 HNH domain

SEQ ID NO: 4929 - protein, 160 aa, unidentified
  REGION 1..160: note = Description of Unknown:uncultivated organism with predicted taxonomy: Treponema pedis
  REGION 1..160: note = MG16-213 HNH domain
ELKQSKDERNEVFLRNNKRERENAEITKRIEEYGIRPSRSRIQKYRLWEESNHICFYCGQPVGAKEFLSGVDVEIEHIIPRSLFFDDSFSNKVCACRKCNQDKGNSTAFDFMKAKPEVEFDNYLRRVESYYNEKRISKTKRDRLLTAAKDIPEDFINRQL

SEQ ID NO: 4930 - protein, 177 aa, unidentified
  REGION 1..177: note = Description of Unknown:uncultivated organism with predicted taxonomy:Sediminibacterium sp. C3
  REGION 1..177: note = MG16-214 HNH domain
ELKQSKDERNETFKRNNQNERQNKEYAERIKEYGLTPTRNRIMKMKMWEESEYTCMYCGQPVNVTEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQL

SEQ ID NO: 4931 - protein, 177 aa, unidentified
  REGION 1..177: note = Description of Unknown:uncultivated organism with predicted taxonomy: Prevotella
  REGION 1..177: note = MG16-215 HNH domain
ELKQSRDERNETFKRNNQNERQNKVYAERIKEYGLTPTRNRIMKMKMWEESEYTCMYCGQPVNVTEFLKGADVEREHIIPRGLLFDNSFTNQVCSCRRCNSKKGMRTAYDFIADDKGQDGLNAYIDRINNLFDKKKISRSKLNRLLVSHKAYISRKAQGKETDEDKELWENFIDRQL

SEQ ID NO: 4932 - protein, 177 aa, unidentified
  REGION 1..177: note = Description of Unknown:uncultivated organism with predicted taxonomy: Bacteroidales
  REGION 1..177: note = MG16-216 HNH domain
ELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQL

SEQ ID NO: 4933 - protein, 177 aa, unidentified
  REGION 1..177: note = Description of Unknown:uncultivated organism with predicted taxonomy: Porphyromonascatoniae
  REGION 1..177: note = MG16-217 HNH domain
ELKQSKDERNEAFKRNNQNERQNKEYAERIKVYGLTPTRNRIMKMKMWEESEYTCMYCGQPVNVTEFLQGADVEREHIIPRGLLFDNSFTNQVCSCRRCNSKKGMRTAYDFIADDKGQEGLDAYIDRINDLFNKKKISRSKLNRLLVSHKAYIIRKTQGKETEEDKELWENFIDRQL

SEQ ID NO: 4934 - protein, 177 aa, unidentified
  REGION 1..177: note = Description of Unknown:uncultivated organism with predicted taxonomy: Prevotella
  REGION 1..177: note = MG16-218 HNH domain
ELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMRRKAQGKETDEDKELWENFIDRQL

SEQ ID NO: 4935 - protein, 161 aa, unidentified
  REGION 1..161: note = Description of Unknown:uncultivated organism with predicted taxonomy: Fibrobacter
  REGION 1..161: note = MG16-219 HNH domain
ELKQSKDERNTTFNNIAKRERENKGIAERIKNEYGLIPNRNKIEKYRLWEEAEQKCFYCGQTVNVKEFLSGFDVEVEHVIPKSLLFDNSYANKVCACRKCNANKGNKTAFDFMKSQSEDAFNNYVSRVEEYYKNGKISRTKHDRLLTPQSEIPSDFIERQL

SEQ ID NO: 4936 - protein, 177 aa, unidentified; identical to SEQ ID NO: 4932
  REGION 1..177: note = Description of Unknown:uncultivated organism with predicted taxonomy:Sediminibacterium sp. C3
  REGION 1..177: note = MG16-220 HNH domain

SEQ ID NO: 4937 - protein, 177 aa, unidentified
  REGION 1..177: note = Description of Unknown:uncultivated organism with predicted taxonomy:Sediminibacterium sp. C3
  REGION 1..177: note = MG16-221 HNH domain
ELKQSKDERNETFKRNSQNERNNKEYAERIKEYGLTPTRNRIMKMKMWEESEYTCVYCGQPVNVTEFLKGADVEREHIIPRGLLFDNSFTNQVCSCRLCNSKKGMRTAYDFIADDKGQAGLETYIDRINDLFNRKKISRSKFNRLLVSYKAYISRKAKGKETEEDKELWENFIDRQL

SEQ ID NO: 4938 - protein, 177 aa, unidentified
  REGION 1..177: note = Description of Unknown:uncultivated organism with predicted taxonomy: Prevotella sp.ne3005
  REGION 1..177: note = MG16-222 HNH domain
ELKQSKDERNETFKRNNQNERQNKEYAERIKKYSLTPTRNRIMKLKMWEESEHACMYCEEPVDPIEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQL

SEQ ID NO: 4939 - protein, 177 aa, unidentified
  REGION 1..177: note = Description of Unknown:uncultivated organism with predicted taxonomy: Prevotellacopri
  REGION 1..177: note = MG16-223 HNH domain
ELKQSKDERNETYRRNNQNEKKNNEYAERIKEYGLTPTRNRIMKMKMLEESEYKCMYCGQPVREKEFLQGADVEREHIIPKALLFDNSFTNQVCSCRSCNSQKGMRTAYDFIADDKGQEGLEAYIERINDLFNKKKISRSKLNRLLVSHKAYVSRKAQGKETEEDVQLWENFIDRQL

SEQ ID NO: 4940 - protein, 177 aa, unidentified
  REGION 1..177: note = Description of Unknown:uncultivated organism with predicted taxonomy: Bacteroides sp.CAG:770
  REGION 1..177: note = MG16-224 HNH domain
ELKQSKDERNEAFKRNNQNERQNKELAERIKNYGLTPTRNRIMKLKMWEESEHSCMYCKQPVDPIEFLKGADVEREHIIPRGLLFDNSFTNQVCSCRRCNSQKGMRTAYDFIADDKGQEGLNAYIEHINDLFEKKKISRSKLNRLLVSHKAYLSRKAQGRETEEDKELWENFIDRQL

SEQ ID NO: 4941 - protein, 160 aa, unidentified
  REGION 1..160: note = Description of Unknown:uncultivated organism with predicted taxonomy: Bacteroidales
  REGION 1..160: note = MG16-225 HNH domain
ELKQSKDERAQTTERINKNERENKAIEERIREHGIRPSRARIQKYKMWEESQHQCFYCGKSISAAEFLSGADVEVEHIIPKSILFDDSFSNKVCACRDCNHTKDNLTARDFMETRGQAELDAYLARVNTAFEEGRISKTKRDHLLWHKEEIPQDFIDRQL

SEQ ID NO: 4942 - protein, 160 aa, unidentified
  REGION 1..160: note = Description of Unknown:uncultivated organism
  REGION 1..160: note = MG16-226 HNH domain
ELKQSRDERKDAFDRNNENEKRNKKISALISEQGIRPSRSRIQKYKMWEESEHRCMYCGKVVNLSEFLNGADVEIEHIIPRSILFDDSFSNKVCACRDCNREKDNMTAMDYMASKPEGEFEAYKQRVDEAFNAHRISKTKRDHLLWRRADIPQAFIDRQL

SEQ ID NO: 4943 - protein, 160 aa, unidentified
  REGION 1..160: note = Description of Unknown:uncultivated organism with predicted taxonomy: Bacteroidales
  REGION 1..160: note = MG16-228 HNH domain
ELKSSKEEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQL

SEQ ID NO: 4944 - protein, 160 aa, unidentified
  REGION 1..160: note = Description of Unknown:uncultivated organism with predicted taxonomy: Bacteroidales
  REGION 1..160: note = MG16-229 HNH domain
ELKSSKDEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQL

SEQ ID NO: 4945 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-230 HNH domain

SEQ ID NO: 4946 - protein, 160 aa, unidentified; identical to SEQ ID NO: 4798
  REGION 1..160: note = Description of Unknown:uncultivated organism with predicted taxonomy: Bacteroides sp.CAG:770
  REGION 1..160: note = MG16-231 HNH domain

SEQ ID NO: 4947 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-232 HNH domain

SEQ ID NO: 4948 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-233 HNH domain

SEQ ID NO: 4949 - protein, 160 aa, unidentified
  REGION 1..160: note = Description of Unknown:uncultivated organism with predicted taxonomy: Bacteroides sp.CAG:770
  REGION 1..160: note = MG16-234 HNH domain
ELKLSKEGRESAAKNIRAREKANEEIAKRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQL

SEQ ID NO: 4950 - protein, 160 aa, unidentified; identical to SEQ ID NO: 4949
  REGION 1..160: note = Description of Unknown:uncultivated organism with predicted taxonomy: Bacteroides sp.CAG:770
  REGION 1..160: note = MG16-235 HNH domain

SEQ ID NO: 4951 - protein, 160 aa, unidentified; identical to SEQ ID NO: 4787
  REGION 1..160: note = Description of Unknown:uncultivated organism with predicted taxonomy: Bacteroides sp.CAG:770
  REGION 1..160: note = MG16-236 HNH domain

SEQ ID NO: 4952 - protein, 160 aa, unidentified; identical to SEQ ID NO: 4741
  REGION 1..160: note = Description of Unknown:uncultivated organism with predicted taxonomy: Bacteroides sp.CAG:770
  REGION 1..160: note = MG16-237 HNH domain

SEQ ID NO: 4953 - protein, 160 aa, unidentified; identical to SEQ ID NO: 4741
  REGION 1..160: note = Description of Unknown:uncultivated organism with predicted taxonomy: Bacteroides sp.CAG:545
  REGION 1..160: note = MG16-238 HNH domain

SEQ ID NO: 4954 - protein, 160 aa, unidentified; identical to SEQ ID NO: 4754
  REGION 1..160: note = Description of Unknown:uncultivated organism with predicted taxonomy: Bacteroides sp.CAG:770
  REGION 1..160: note = MG16-239 HNH domain

SEQ ID NO: 4955 - protein, 160 aa, unidentified; identical to SEQ ID NO: 4754
  REGION 1..160: note = Description of Unknown:uncultivated organism with predicted taxonomy: Bacteroides sp.CAG:709
  REGION 1..160: note = MG16-240 HNH domain

SEQ ID NO: 4956 - protein, 160 aa, unidentified; identical to SEQ ID NO: 4754
  REGION 1..160: note = Description of Unknown:uncultivated organism with predicted taxonomy: Bacteroides sp.CAG:770
  REGION 1..160: note = MG16-242 HNH domain

SEQ ID NO: 4957 - protein, 160 aa, unidentified
  REGION 1..160: note = Description of Unknown:uncultivated organism with predicted taxonomy: Bacteroides sp.CAG:709
  REGION 1..160: note = MG16-243 HNH domain
ELKLSKEGRAATAKNIRDREKENKEIAEKIIELGVTPSKNKILKYRLWQEAGQKCFYCGQPVGATEFLNGLDVEIEHVVPKTLLFDDSFSNKVCACRKCNAEKRNSTAYDYMKSKGENAFNDYLRRVDTAFSEHKISFTKRSRLLTPADKIPKDFISRQL

SEQ ID NO: 4958 - protein, 160 aa, unidentified
  REGION 1..160: note = Description of Unknown:uncultivated organism with predicted taxonomy: Bacteroidales
  REGION 1..160: note = MG16-245 HNH domain
ELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKDNATAMEYMAGKPTGEFEAYKQRVDEAFTEHRISKTKRDHLLWRRADIPQDFIERQL

SEQ ID NO: 4959 - protein, 177 aa, unidentified
  REGION 1..177: note = Description of Unknown:uncultivated organism with predicted taxonomy: Bacteroides sp.CAG:770
  REGION 1..177: note = MG16-246 HNH domain
ELKQSKDERNEAFKRNNQNERQNKEYAERIKEYGLTPTRNRIMKMKMWEESEYTCMYCGQPVNVTEFLQGADVEREHIIPRALLFDNSFTNQVCSCRRCNSQKGMRTAYDFIEDDKGQEGLNAYIERINDLFNRKKISRSKFNRLLVSHKAYISRKAQGKETEENKELWENFIDRQL

SEQ ID NO: 4960 - protein, 160 aa, unidentified
  REGION 1..160: note = Description of Unknown:uncultivated organism with predicted taxonomy: Porphyromonassp. oral taxon 278
  REGION 1..160: note = MG16-247 HNH domain
ELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQL

SEQ ID NO: 4961 - protein, 160 aa, unidentified
  REGION 1..160: note = Description of Unknown:uncultivated organism with predicted taxonomy: Coprobacter sp.
  REGION 1..160: note = MG16-248 HNH domain
ELKQSREERDSAYKAINKNERDNAAIAAKIAEFGVRPSRSRIQKYKMWEESNHRCFYCGKIMDITQFLNGADVEIEHIIPRSILFDDSYSNKVCACRDCNHEKDNSTAMEYMESKPAGEFEAYKQRVDEAFSAHRISKTKRDHLLWRRGDIPQDFIERQL

SEQ ID NO: 4962 - protein, 160 aa, unidentified; identical to SEQ ID NO: 4871
  REGION 1..160: note = Description of Unknown:uncultivated organism with predicted taxonomy: Bacteroides sp.CAG:144
  REGION 1..160: note = MG16-249 HNH domain

SEQ ID NO: 4963 - protein, 177 aa, unidentified
  REGION 1..177: note = Description of Unknown:uncultivated organism with predicted taxonomy:Sediminibacterium sp. C3
  REGION 1..177: note = MG16-250 HNH domain
ELKQSKDERNETFKRNNQNERQNKEYAERIKEYGLTPTRNRIIKMKMWEESEYTCMYCGQPVNVTEFLKGADVEREHIIPRGLLFDNSFTNQVCSCRRCNSKKGMRTAYDFIADDKGQEGLNAYIDRINNLFDKKKISRSKLNRLLVSHKAYISRKAQGKETEEDKELWENFIDRQL

SEQ ID NO: 4964 - protein, 174 aa, unidentified
  REGION 1..174: note = Description of Unknown:uncultivated organism with predicted taxonomy: Bacteroides sp.CAG:144
  REGION 1..174: note = MG16-251 HNH domain
ELKQSKEEREETERGIRKQQKANDGYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQL

SEQ ID NO: 4965 - protein, 160 aa, unidentified
  REGION 1..160: note = Description of Unknown:uncultivated organism with predicted taxonomy: Bacteroidales
  REGION 1..160: note = MG16-252 HNH domain
ELKQSRDERNDAYLSINKRERENKVIEERIREYGISPSKSRIQKYRLWEESNHLCFYCGHPVGAAEFLSGSGVEIEHIIPRSLLFDDSFANKVCACRKCNAEKGNSTAFDYMKSKPANDFEDYLKRVEKYFTEKRISKTKRERLLTPASEIPQDFIDRQL

SEQ ID NO: 4966 - protein, 174 aa, unidentified
  REGION 1..174: note = Description of Unknown:uncultivated organism
  REGION 1..174: note = MG16-253 HNH domain
ELKQSKEEREETDKGIRKQQKANEEYADILKKKGVRPTRNRILKYRLWKESEEACFYCGRDIDFHEFLRFSDVEREHVIPKKLLFDDSFANQVCSCRRCNAEKGGRTALDYMRTKPNLQEYLDKVDKLFQEHKIGGKKHAHLLASYDDYLSRKKEGKETKDDIMIWEEPIDRQL

SEQ ID NO: 4967 - protein, 160 aa, unidentified
  REGION 1..160: note = Description of Unknown:uncultivated organism with predicted taxonomy:Marinilabiliaceae
  REGION 1..160: note = MG16-254 HNH domain
ELKQSRDERESAYKAMGQNERRNKEIAEKISEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPADFIERQL

SEQ ID NO: 4968 - protein, 175 aa, unidentified
  REGION 1..175: note = Description of Unknown:uncultivated organism with predicted taxonomy: Bacteroidetes
  REGION 1..175: note = MG16-255 HNH domain
ELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQL

SEQ ID NO: 4969 - protein, 174 aa, unidentified
  REGION 1..174: note = Description of Unknown:uncultivated organism with predicted taxonomy: Bacteroides sp.CAG:144
  REGION 1..174: note = MG16-256 HNH domain
ELKQSKEEREETERGIRKQQKANDEYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQL

SEQ ID NO: 4970 - protein, 160 aa, unidentified
  REGION 1..160: note = Description of Unknown:uncultivated organism with predicted taxonomy: Bacteroidia
  REGION 1..160: note = MG16-257 HNH domain
ELKQSREEREGAYRRNNQNERLNKEIFAKIEEMGIRPSRSRIQKYKMWEESNHRCMYCGKTVSLAEFLNGAEVEIEHIIPRSILFDDSFSNKVCACRECNHEKGNLTALDYLETKPTAEQEAYKQRVDEAFKEGRISKTKRDHLLWHRSDIPTDFIDRQL

SEQ ID NO: 4971 - protein, 160 aa, unidentified; identical to SEQ ID NO: 4960
  REGION 1..160: note = Description of Unknown:uncultivated organism with predicted taxonomy: Bacteroidales
  REGION 1..160: note = MG16-258 HNH domain

SEQ ID NO: 4972 - protein, 160 aa, unidentified; identical to SEQ ID NO: 4856
  REGION 1..160: note = Description of Unknown:uncultivated organism with predicted taxonomy: Prevotellasaccharolytica
  REGION 1..160: note = MG16-259 HNH domain

SEQ ID NO: 4973 - protein, 175 aa, unidentified; identical to SEQ ID NO: 4968
  REGION 1..175: note = Description of Unknown:uncultivated organism with predicted taxonomy: Bacteroides sp.CAG:770
  REGION 1..175: note = MG16-260 HNH domain

SEQ ID NO: 4974 - protein, 161 aa, unidentified
  REGION 1..161: note = Description of Unknown:uncultivated organism with predicted taxonomy: Bacteroidales
  REGION 1..161: note = MG16-261 HNH domain
ELKQSKDERNTTFNNIAKRERENKGIAERIKNEYGLIPNRNKIEKFRLCEESDHKCFYCGQAVNAKEFLLGSDVEVEHVIPKSLLFDDSFANKVCACRKCNAQKGNKTAFDFMKSQSEDEFNNYVSRVEEYYKNGKISRTKHDRLLTPQTEIPSDFIERQL

SEQ ID NO: 4975 - protein, 177 aa, unidentified
  REGION 1..177: note = Description of Unknown:uncultivated organism with predicted taxonomy: Porphyromonascatoniae
  REGION 1..177: note = MG16-262 HNH domain
ELKQSKDERNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQL

SEQ ID NO: 4976 - protein, 177 aa, unidentified
  REGION 1..177: note = Description of Unknown:uncultivated organism with predicted taxonomy:Sediminibacterium sp. C3
  REGION 1..177: note = MG16-263 HNH domain
ELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWENFIDRQL

SEQ ID NO: 4977 - protein, 197 aa, unidentified
  REGION 1..197: note = Description of Unknown:uncultivated organism
  REGION 1..197: note = MG16-264 HNH domain
ELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTEFDFMRSQDKAVFDDYIKRVEKWFDDGIISPSKRERLLLSHEDYLERKKKGKTTEEDKKYWEEFVSRQA

SEQ ID NO: 4978 - protein, 177 aa, unidentified
  REGION 1..177: note = Description of Unknown:uncultivated organism
  REGION 1..177: note = MG16-265 HNH domain
ELKQSKDERNETFKRNSQNERKNKEYAERIKEYGLTPTRNRIMKMKMWEESEHSCMYCGQPVDVKEFLQGADVEREHIVPRGLLFDNSFTNQVCSCRRCNSQKGMRTAYDFIEDDKGEAGLNSYIEHINYLFDKKQISRNKFNRLLVSHKAYINRKAQGKETEEDKELWENFIDRQL

SEQ ID NO: 4979 - protein, 160 aa, unidentified; identical to SEQ ID NO: 4909
  REGION 1..160: note = Description of Unknown:uncultivated organism with predicted taxonomy: Porphyromonassp. oral taxon 278
  REGION 1..160: note = MG16-266 HNH domain

SEQ ID NO: 4980 - protein, 177 aa, unidentified
  REGION 1..177: note = Description of Unknown:uncultivated organism
  REGION 1..177: note = MG16-267 HNH domain
HLNKNKYQRNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQL

SEQ ID NO: 4981 - protein, 174 aa, unidentified
  REGION 1..174: note = Description of Unknown:uncultivated organism with predicted taxonomy: Prevotella
  REGION 1..174: note = MG16-268 HNH domain
ELKMDRESRHRKFTQNNSRKRQNEEYADKINEHGIIPTRNRVIKYRLWEEANMQCFYCGQPINITELLRDPTIEKEHIIPKALLLDNSYSNLVCSCRKCNQEKGARTAYDYMRQKSDLDAYIKRINKLAETQKISQTKRLHLLASYEDYLVRKRLGKATEEDRNLWEEFINRQL

SEQ ID NO: 4982 - protein, 177 aa, unidentified; identical to SEQ ID NO: 4932
  REGION 1..177: note = Description of Unknown:uncultivated organism with predicted taxonomy: Bacteroidales
  REGION 1..177: note = MG16-269 HNH domain

SEQ ID NO: 4983 - protein, 160 aa, unidentified
  REGION 1..160: note = Description of Unknown:uncultivated organism with predicted taxonomy: Bacteroidales
  REGION 1..160: note = MG16-270 HNH domain
ELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKGNSTAMEYMEGKPTGEFEAYKQRVDEAFTEHRISKTKRDHLLWRRADIPQDFIERQL

SEQ ID NO: 4984 - protein, 160 aa, unidentified
  REGION 1..160: note = Description of Unknown:uncultivated organism with predicted taxonomy: Bacteroidales
  REGION 1..160: note = MG16-271 HNH domain
ELKQNKEERETTYKNNSKNERLNREITERIKEMGIRPSRMRVQKYKLWEESLHQCFYCGKTVGAAEFLSGADVEIEHIIPRSVLFDDSYSNKVCACRECNHAKNNQTAFDFMKAQSTDKFEAYKSRVDDAFKEKRISKTKRDHLLWGLEDIPQDFIDRQL

SEQ ID NO: 4985 - protein, 177 aa, unidentified
  REGION 1..177: note = Description of Unknown:uncultivated organism with predicted taxonomy: Bacteroides sp.CAG:770
  REGION 1..177: note = MG16-272 HNH domain
ELKQSKDERNEAFKRNNQNERQNKDYAERIKEYGLTPTRNRIMKMRMWEESEYTCMYCGQPVNVTEFLKGADVEREHIIPRGLLFDNSFTNQVCSCRRCNSKKGMRTAYDFIADEKGQEGLDTYIDRINDLFNRKKISRSKLNRLFVSYKAYMSRKAQGKETDEDKDLWENFIDRQL

SEQ ID NO: 4986 - protein, 177 aa, unidentified
  REGION 1..177: note = Description of Unknown:uncultivated organism with predicted taxonomy: Bacteroidetes
  REGION 1..177: note = MG16-273 HNH domain
ELKQSKDERNETFKRNNQNERQNKEYAERIKKYGLTPTRNRIMKLKMWEESEHACMYCEQPVDPIEFLKGADVEREHIIPRGLLFDNSFTNQVCSCRRCNSKKGMRTAYDFIADDKGQEGLNAYIEHINDLFDKKKISRSKLNRLLVSHKAYISRKAQGKETEEDKELWENFIDRQL

SEQ ID NO: 4987 - protein, 174 aa, unidentified
  REGION 1..174: note = Description of Unknown:uncultivated organism with predicted taxonomy: Bacteroidales
  REGION 1..174: note = MG16-274 HNH domain
ELKQSKEEREETDKGIRKQQKANEEYADILKKKGVRPTRNRILKYRLWKESEEACFYCGRDIDFHEFLRFSDIEREHVIPKKLLFDDSFANQVCSCRRCNAEKGGRTALDYMRTKPNLQEYLDKVDKMFQEHKIGGKKHTHLLASYDDYLSRKKEGKETKDDILIWEEPIDRQL

SEQ ID NO: 4988 - protein, 197 aa, unidentified
  REGION 1..197: note = Description of Unknown:uncultivated organism with predicted taxonomy: Bacteroidetes
  REGION 1..197: note = MG16-275 HNH domain
ELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTAFDFMRSQDKAMFDDYIKRVEKWFDDGIISPSKRERLLLSHEDYMERKKKGKTTEEDKKYWEEFVSRQA

SEQ ID NO: 4989 - protein, 162 aa, unidentified
  REGION 1..162: note = Description of Unknown:uncultivated organism with predicted taxonomy: Clostridiales
  REGION 1..162: note = MG18-1 HNH domain
GVSPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQTMRQTALWKALLEKGLISKQKYLRLTRTTPFTEEELAGFINRQL

SEQ ID NO: 4990 - protein, 168 aa, unidentified
  REGION 1..168: note = Description of Unknown:uncultivated organism with predicted taxonomy:Phascolarctobacterium succinatutens
  REGION 1..168: note = MG18-3 HNH domain
SKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 4991 - protein, 168 aa, unidentified
  REGION 1..168: note = Description of Unknown:uncultivated organism with predicted taxonomy:Phascolarctobacterium succinatutens
  REGION 1..168: note = MG18-4 HNH domain
SKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQL

SEQ ID NO: 4992 - protein, 168 aa, unidentified
  REGION 1..168: note = Description of Unknown:uncultivated organism with predicted taxonomy:Phascolarctobacterium succinatutens
  REGION 1..168: note = MG18-5 HNH domain
SKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 4993 - protein, 168 aa, unidentified; identical to SEQ ID NO: 4990
  REGION 1..168: note = Description of Unknown:uncultivated organism with predicted taxonomy:Phascolarctobacterium
  REGION 1..168: note = MG18-6 HNH domain

SEQ ID NO: 4994 - protein, 168 aa, unidentified
  REGION 1..168: note = Description of Unknown:uncultivated organism with predicted taxonomy:Acidaminococcales
  REGION 1..168: note = MG18-7 HNH domain
SKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQL

SEQ ID NO: 4995 - protein, 168 aa, unidentified
  REGION 1..168: note = Description of Unknown:uncultivated organism
  REGION 1..168: note = MG18-8 HNH domain
SKEESKRTDSRLKKLQDLYKKCKEENIDFVPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 4996 - protein, 168 aa, unidentified
  REGION 1..168: note = Description of Unknown:uncultivated organism with predicted taxonomy:Phascolarctobacterium succinatutens
  REGION 1..168: note = MG18-9 HNH domain
SKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 4997 - protein, 168 aa, unidentified; identical to SEQ ID NO: 4996
  REGION 1..168: note = Description of Unknown:uncultivated organism with predicted taxonomy:Phascolarctobacterium
  REGION 1..168: note = MG18-10 HNH domain

SEQ ID NO: 4998 - protein, 168 aa, unidentified
  REGION 1..168: note = Description of Unknown:uncultivated organism with predicted taxonomy:Phascolarctobacterium succinatutens
  REGION 1..168: note = MG18-11 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 4999 - protein, 168 aa, unidentified
  REGION 1..168: note = Description of Unknown:uncultivated organism with predicted taxonomy:Phascolarctobacterium succinatutens
  REGION 1..168: note = MG18-12 HNH domain
SKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5000 - protein, 168 aa, unidentified; identical to SEQ ID NO: 4991
  REGION 1..168: note = Description of Unknown:uncultivated organism with predicted taxonomy:Phascolarctobacterium succinatutens
  REGION 1..168: note = MG18-13 HNH domain

SEQ ID NO: 5001 - protein, 168 aa, unidentified; identical to SEQ ID NO: 4996
  REGION 1..168: note = Description of Unknown:uncultivated organism with predicted taxonomy:Phascolarctobacterium
  REGION 1..168: note = MG18-14 HNH domain

SEQ ID NO: 5002 - protein, 168 aa, unidentified
  REGION 1..168: note = Description of Unknown:uncultivated organism with predicted taxonomy:Phascolarctobacterium succinatutens
  REGION 1..168: note = MG18-15 HNH domain
SKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQL

SEQ ID NO: 5003 - protein, 168 aa, unidentified; identical to SEQ ID NO: 4999
  REGION 1..168: note = Description of Unknown:uncultivated organism with predicted taxonomy:Phascolarctobacterium succinatutens
  REGION 1..168: note = MG18-16 HNH domain

SEQ ID NO: 5004 - protein, 168 aa, unidentified; identical to SEQ ID NO: 4996
  REGION 1..168: note = Description of Unknown:uncultivated organism with predicted taxonomy:Phascolarctobacterium
  REGION 1..168: note = MG18-17 HNH domain

SEQ ID NO: 5005 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-18 HNH domain

SEQ ID NO: 5006 - protein, 168 aa, unidentified; identical to SEQ ID NO: 4996
  REGION 1..168: note = Description of Unknown:uncultivated organism with predicted taxonomy:Phascolarctobacterium
  REGION 1..168: note = MG18-19 HNH domain

SEQ ID NO: 5007 - protein, 168 aa, unidentified; identical to SEQ ID NO: 4996
  REGION 1..168: note = Description of Unknown:uncultivated organism with predicted taxonomy:Phascolarctobacterium
  REGION 1..168: note = MG18-20 HNH domain

SEQ ID NO: 5008 - protein, 168 aa, unidentified; identical to SEQ ID NO: 4996
  REGION 1..168: note = Description of Unknown:uncultivated organism with predicted taxonomy:Phascolarctobacterium
  REGION 1..168: note = MG18-21 HNH domain

SEQ ID NO: 5009 - protein, 168 aa, unidentified; identical to SEQ ID NO: 4991
  REGION 1..168: note = Description of Unknown:uncultivated organism with predicted taxonomy:Phascolarctobacterium
  REGION 1..168: note = MG18-22 HNH domain

SEQ ID NO: 5010 - protein, 168 aa, unidentified
  REGION 1..168: note = Description of Unknown:uncultivated organism with predicted taxonomy:Phascolarctobacterium succinatutens
  REGION 1..168: note = MG18-23 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQL

SEQ ID NO: 5011 - protein, 168 aa, unidentified
  REGION 1..168: note = Description of Unknown:uncultivated organism with predicted taxonomy:Phascolarctobacterium
  REGION 1..168: note = MG18-24 HNH domain
SKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5012 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-25 HNH domain

SEQ ID NO: 5013 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-26 HNH domain

SEQ ID NO: 5014 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-27 HNH domain

SEQ ID NO: 5015 - protein, 168 aa, unidentified
  REGION 1..168: note = Description of Unknown:uncultivated organism with predicted taxonomy:Phascolarctobacterium
  REGION 1..168: note = MG18-28 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5016 - protein, 168 aa, unidentified
  REGION 1..168: note = Description of Unknown:uncultivated organism with predicted taxonomy:Phascolarctobacterium succinatutens
  REGION 1..168: note = MG18-29 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 5017 - protein, 168 aa, unidentified
  REGION 1..168: note = Description of Unknown:uncultivated organism with predicted taxonomy:Phascolarctobacterium succinatutens
  REGION 1..168: note = MG18-30 HNH domain
SKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQL

SEQ ID NO: 5018 - protein, 168 aa, unidentified; identical to SEQ ID NO: 5017
  REGION 1..168: note = Description of Unknown:uncultivated organism with predicted taxonomy:Phascolarctobacterium succinatutens
  REGION 1..168: note = MG18-31 HNH domain

SEQ ID NO: 5019 - protein, 168 aa, unidentified
  REGION 1..168: note = Description of Unknown:uncultivated organism with predicted taxonomy:Phascolarctobacterium succinatutens
  REGION 1..168: note = MG18-32 HNH domain
SKEESKRTDSRLKKLQDLYKQCREENIDFMPRKDEFNTLKTQLSSKKEDDLRIDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5020 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-33 HNH domain

SEQ ID NO: 5021 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-34 HNH domain

SEQ ID NO: 5022 - protein, 168 aa, unidentified; identical to SEQ ID NO: 4999
  REGION 1..168: note = Description of Unknown:uncultivated organism with predicted taxonomy:Phascolarctobacterium succinatutens
  REGION 1..168: note = MG18-35 HNH domain

SEQ ID NO: 5023 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-36 HNH domain

SEQ ID NO: 5024 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-37 HNH domain

SEQ ID NO: 5025 - protein, 168 aa, unidentified; identical to SEQ ID NO: 5017
  REGION 1..168: note = Description of Unknown:uncultivated organism with predicted taxonomy:Phascolarctobacterium
  REGION 1..168: note = MG18-38 HNH domain

SEQ ID NO: 5026 - protein, 168 aa, unidentified
  REGION 1..168: note = Description of Unknown:uncultivated organism with predicted taxonomy:Phascolarctobacterium
  REGION 1..168: note = MG18-39 HNH domain
SKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 5027 - protein, 168 aa, unidentified; identical to SEQ ID NO: 5016
  REGION 1..168: note = Description of Unknown:uncultivated organism with predicted taxonomy:Phascolarctobacterium succinatutens
  REGION 1..168: note = MG18-40 HNH domain

SEQ ID NO: 5028 - protein, 168 aa, unidentified
  REGION 1..168: note = Description of Unknown:uncultivated organism with predicted taxonomy:Phascolarctobacterium succinatutens
  REGION 1..168: note = MG18-41 HNH domain
SKEESKRTDSRLKKLQDLYKKCREENIDFMPRKDEFNALKIQLNSKKDYDLRSDKLYLYYTQMGRCMYTGERIELASLYDDNLYDIDHIYPRSKTKDDSLSNRVLVKKEVNAAKTDIYPLDAAIRTKMHSFWKLLYDKGLIDERKYERLTRSTQLRDEELAGFISRQL

SEQ ID NO: 5029 - protein, 168 aa, unidentified; identical to SEQ ID NO: 4990
  REGION 1..168: note = Description of Unknown:uncultivated organism with predicted taxonomy:Phascolarctobacterium succinatutens
  REGION 1..168: note = MG18-42 HNH domain

SEQ ID NO: 5030 - protein, 168 aa, unidentified; identical to SEQ ID NO: 4999
  REGION 1..168: note = Description of Unknown:uncultivated organism with predicted taxonomy:Phascolarctobacterium succinatutens
  REGION 1..168: note = MG18-43 HNH domain

SEQ ID NO: 5031 - protein, 168 aa, unidentified; identical to SEQ ID NO: 5002
  REGION 1..168: note = Description of Unknown:uncultivated organism with predicted taxonomy:Phascolarctobacterium succinatutens
  REGION 1..168: note = MG18-44 HNH domain

SEQ ID NO: 5032 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-45 HNH domain

SEQ ID NO: 5033 - protein, 168 aa, unidentified
  REGION 1..168: note = Description of Unknown:uncultivated organism with predicted taxonomy:Phascolarctobacterium
  REGION 1..168: note = MG18-46 HNH domain
SKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5034 - protein, 168 aa, unidentified; identical to SEQ ID NO: 4994
  REGION 1..168: note = Description of Unknown:uncultivated organism with predicted taxonomy:Phascolarctobacterium
  REGION 1..168: note = MG18-47 HNH domain

SEQ ID NO: 5035 - protein, 168 aa, unidentified
  REGION 1..168: note = Description of Unknown:uncultivated organism with predicted taxonomy:Phascolarctobacterium succinatutens
  REGION 1..168: note = MG18-48 HNH domain
SKEESKRTDSRLKKLQDLYKKCREENIDFMPRKDEFNALKTQLSSKKEENLRSDKLYLYYTQMGRCMYTGERIELASLDDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5036 - protein, 168 aa, unidentified; identical to SEQ ID NO: 5016
  REGION 1..168: note = Description of Unknown:uncultivated organism with predicted taxonomy:Phascolarctobacterium succinatutens
  REGION 1..168: note = MG18-49 HNH domain

SEQ ID NO: 5037 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-50 HNH domain

SEQ ID NO: 5038 - protein, 168 aa, unidentified
  REGION 1..168: note = Description of Unknown:uncultivated organism with predicted taxonomy:Phascolarctobacterium succinatutens
  REGION 1..168: note = MG18-51 HNH domain
SKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5039 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-52 HNH domain

SEQ ID NO: 5040 - protein, 168 aa, unidentified
  REGION 1..168: note = Description of Unknown:uncultivated organism with predicted taxonomy: Firmicutes
  REGION 1..168: note = MG18-53 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRNTQLGDEELAGFISRQL

SEQ ID NO: 5041 - protein, 168 aa, unidentified
  REGION 1..168: note = Description of Unknown:uncultivated organism with predicted taxonomy:Phascolarctobacterium
  REGION 1..168: note = MG18-54 HNH domain
SKEESKRTDSRLKKLQDLYKQCKEENIDFMPHTDELNAFKIQLSSKKEDDLRSDKLYLYYTQMGRCMYTGERIEIASLYDDNLYDIDHIYPRSKTKDDSLSNRVLVKKEVNAAKTDIYPLDAAIRTKMHTFWKLLYDKGFIDERKYERLIRSKQLRDEELAGFISRQL

SEQ ID NO: 5042 - protein, 168 aa, unidentified; identical to SEQ ID NO: 5026
  REGION 1..168: note = Description of Unknown:uncultivated organism with predicted taxonomy:Phascolarctobacterium
  REGION 1..168: note = MG18-55 HNH domain

SEQ ID NO: 5043 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-56 HNH domain

SEQ ID NO: 5044 - protein, 168 aa, unidentified
  REGION 1..168: note = Description of Unknown:uncultivated organism with predicted taxonomy:Phascolarctobacterium succinatutens
  REGION 1..168: note = MG18-57 HNH domain
SKEESKRTDSRLKKLHDLYKKCREENIDFMPRKDEFNALKTQLSSKKEENLRSDKLYLYYTQMGRCMYTGERIELASLHDNNLYDIDHIYPRSKTKDDSLSNRVLVKKQINAAKTDTYPLDAAIRTKMHSFWKLLYDKGFIDERKYERLTRSTQLRDEELAGFISRQL

SEQ ID NO: 5045 - protein, 168 aa, unidentified
  REGION 1..168: note = Description of Unknown:uncultivated organism with predicted taxonomy:Phascolarctobacterium succinatutens
  REGION 1..168: note = MG18-58 HNH domain
SKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5046 - protein, 168 aa, unidentified; identical to SEQ ID NO: 5040
  REGION 1..168: note = Description of Unknown:uncultivated organism with predicted taxonomy:Phascolarctobacterium succinatutens
  REGION 1..168: note = MG18-59 HNH domain

SEQ ID NO: 5047 - protein, 168 aa, unidentified; identical to SEQ ID NO: 5016
  REGION 1..168: note = Description of Unknown:uncultivated organism
  REGION 1..168: note = MG18-60 HNH domain

SEQ ID NO: 5048 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-61 HNH domain

SEQ ID NO: 5049 - protein, 168 aa, unidentified
  REGION 1..168: note = Description of Unknown:uncultivated organism with predicted taxonomy:Phascolarctobacterium succinatutens
  REGION 1..168: note = MG18-62 HNH domain
SKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5050 - protein, 168 aa, unidentified; identical to SEQ ID NO: 5011
  REGION 1..168: note = Description of Unknown:uncultivated organism
  REGION 1..168: note = MG18-63 HNH domain

SEQ ID NO: 5051 - protein, 168 aa, unidentified
  REGION 1..168: note = Description of Unknown:uncultivated organism with predicted taxonomy:Phascolarctobacterium succinatutens
  REGION 1..168: note = MG18-64 HNH domain
SKEESKRTDSRLKKLQYLYKKCREENIDFMPRKDEFNALKTQLSSKKEEDLRSDKLYLYYTQMGRCMYTGESIELASLYDNNLYDIDHIYPRSKTKDDSLSNRVLVQKQVNAAKTDIYPLDAAIRTKMHSFWNLLYDKGFIDERKYERLMRSTQLRDEELAGFISRQL

SEQ ID NO: 5052 - protein, 168 aa, unidentified; identical to SEQ ID NO: 5016
  REGION 1..168: note = Description of Unknown:uncultivated organism with predicted taxonomy: Firmicutes
  REGION 1..168: note = MG18-65 HNH domain

SEQ ID NO: 5053 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-66 HNH domain

SEQ ID NO: 5054 - protein, 168 aa, unidentified; identical to SEQ ID NO: 4998
  REGION 1..168: note = Description of Unknown:uncultivated organism
  REGION 1..168: note = MG18-67 HNH domain

SEQ ID NO: 5055 - protein, 168 aa, unidentified; identical to SEQ ID NO: 5016
  REGION 1..168: note = Description of Unknown:uncultivated organism with predicted taxonomy:Phascolarctobacterium succinatutens
  REGION 1..168: note = MG18-68 HNH domain

SEQ ID NO: 5056 - protein, 168 aa, unidentified
  REGION 1..168: note = Description of Unknown:uncultivated organism with predicted taxonomy:Phascolarctobacterium succinatutens
  REGION 1..168: note = MG18-69 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQL

SEQ ID NO: 5057 - protein, 168 aa, unidentified; identical to SEQ ID NO: 4995
  REGION 1..168: note = Description of Unknown:uncultivated organism with predicted taxonomy: Negativicutes
  REGION 1..168: note = MG18-70 HNH domain

SEQ ID NO: 5058 - protein, 168 aa, unidentified; identical to SEQ ID NO: 5016
  REGION 1..168: note = Description of Unknown:uncultivated organism with predicted taxonomy:Phascolarctobacterium succinatutens
  REGION 1..168: note = MG18-71 HNH domain

SEQ ID NO: 5059 - protein, 168 aa, unidentified
  REGION 1..168: note = Description of Unknown:uncultivated organism with predicted taxonomy:Phascolarctobacterium succinatutens
  REGION 1..168: note = MG18-72 HNH domain
SKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5060 - protein, 168 aa, unidentified; identical to SEQ ID NO: 5038
  REGION 1..168: note = Description of Unknown:uncultivated organism with predicted taxonomy:Phascolarctobacterium
  REGION 1..168: note = MG18-73 HNH domain

SEQ ID NO: 5061 - protein, 168 aa, unidentified; identical to SEQ ID NO: 5026
  REGION 1..168: note = Description of Unknown:uncultivated organism with predicted taxonomy:Phascolarctobacterium succinatutens
  REGION 1..168: note = MG18-74 HNH domain

SEQ ID NO: 5062 - protein, 168 aa, unidentified; identical to SEQ ID NO: 4990
  REGION 1..168: note = Description of Unknown:uncultivated organism with predicted taxonomy:Phascolarctobacterium
  REGION 1..168: note = MG18-75 HNH domain

SEQ ID NO: 5063 - protein, 168 aa, unidentified; identical to SEQ ID NO: 4992
  REGION 1..168: note = Description of Unknown:uncultivated organism with predicted taxonomy:Phascolarctobacterium succinatutens
  REGION 1..168: note = MG18-76 HNH domain

SEQ ID NO: 5064 - protein, 20 aa, unidentified
  REGION 1..20: note = Description of Unknown:uncultivated organism with predicted taxonomy: Clostridiales
  REGION 1..20: note = MG18-77 HNH domain
SKEESKRTDSRLKKLQGRKY

SEQ ID NO: 5065 - protein, 168 aa, unidentified; identical to SEQ ID NO: 5011
  REGION 1..168: note = Description of Unknown:uncultivated organism with predicted taxonomy:Phascolarctobacterium
  REGION 1..168: note = MG18-78 HNH domain

SEQ ID NO: 5066 - protein, 168 aa, unidentified
  REGION 1..168: note = Description of Unknown:uncultivated organism with predicted taxonomy:Phascolarctobacterium succinatutens
  REGION 1..168: note = MG18-79 HNH domain
SKEESKRTDSRLKKLQDLYKKRREENIDFMPRKDEFNALKTQLSSKKEENLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5067 - protein, 168 aa, unidentified; identical to SEQ ID NO: 5010
  REGION 1..168: note = Description of Unknown:uncultivated organism with predicted taxonomy:Phascolarctobacterium succinatutens
  REGION 1..168: note = MG18-80 HNH domain

SEQ ID NO: 5068 - protein, 168 aa, unidentified; identical to SEQ ID NO: 4994
  REGION 1..168: note = Description of Unknown:uncultivated organism with predicted taxonomy:Phascolarctobacterium succinatutens
  REGION 1..168: note = MG18-81 HNH domain

SEQ ID NO: 5069 - protein, 168 aa, unidentified; identical to SEQ ID NO: 4999
  REGION 1..168: note = Description of Unknown:uncultivated organism with predicted taxonomy:Phascolarctobacterium succinatutens
  REGION 1..168: note = MG18-82 HNH domain

SEQ ID NO: 5070 - protein, 168 aa, unidentified; identical to SEQ ID NO: 5015
  REGION 1..168: note = Description of Unknown:uncultivated organism with predicted taxonomy:Phascolarctobacterium succinatutens
  REGION 1..168: note = MG18-83 HNH domain

SEQ ID NO: 5071 - protein, 168 aa, unidentified
  REGION 1..168: note = Description of Unknown:uncultivated organism with predicted taxonomy:Phascolarctobacterium succinatutens
  REGION 1..168: note = MG18-84 HNH domain
SKEESKRTDSRLKKLQDLYKKCKEENIDFMPRKDEFNALKTQLSSKKEDDLRIDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5072 - protein, 168 aa, unidentified; identical to SEQ ID NO: 5010
  REGION 1..168: note = Description of Unknown:uncultivated organism with predicted taxonomy:Phascolarctobacterium
  REGION 1..168: note = MG18-85 HNH domain

SEQ ID NO: 5073 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-86 HNH domain

SEQ ID NO: 5074 - protein, 168 aa, unidentified
  REGION 1..168: note = Description of Unknown:uncultivated organism with predicted taxonomy:Phascolarctobacterium succinatutens
  REGION 1..168: note = MG18-87 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5075 - protein, 168 aa, unidentified; identical to SEQ ID NO: 4990
  REGION 1..168: note = Description of Unknown:uncultivated organism with predicted taxonomy:Phascolarctobacterium
  REGION 1..168: note = MG18-88 HNH domain

SEQ ID NO: 5076 - protein, 168 aa, unidentified
  REGION 1..168: note = Description of Unknown:uncultivated organism with predicted taxonomy: Firmicutes
  REGION 1..168: note = MG18-89 HNH domain
SKEESKRTDSRLKKLQDLYKKCREENIDFMPRKDEFNVLKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQL

SEQ ID NO: 5077 - protein, 168 aa, unidentified; identical to SEQ ID NO: 5026
  REGION 1..168: note = Description of Unknown:uncultivated organism with predicted taxonomy:Phascolarctobacterium
  REGION 1..168: note = MG18-90 HNH domain

SEQ ID NO: 5078 - protein, 168 aa, unidentified; identical to SEQ ID NO: 5015
  REGION 1..168: note = Description of Unknown:uncultivated organism with predicted taxonomy:Phascolarctobacterium succinatutens
  REGION 1..168: note = MG18-91 HNH domain

SEQ ID NO: 5079 - protein, 168 aa, unidentified; identical to SEQ ID NO: 5056
  REGION 1..168: note = Description of Unknown:uncultivated organism with predicted taxonomy:Phascolarctobacterium succinatutens
  REGION 1..168: note = MG18-92 HNH domain

SEQ ID NO: 5080 - protein, 168 aa, unidentified; identical to SEQ ID NO: 4999
  REGION 1..168: note = Description of Unknown:uncultivated organism
  REGION 1..168: note = MG18-93 HNH domain

SEQ ID NO: 5081 - protein, 168 aa, unidentified; identical to SEQ ID NO: 5016
  REGION 1..168: note = Description of Unknown:uncultivated organism with predicted taxonomy:Phascolarctobacterium succinatutens
  REGION 1..168: note = MG18-94 HNH domain

SEQ ID NO: 5082 - protein, 168 aa, unidentified; identical to SEQ ID NO: 5016
  REGION 1..168: note = Description of Unknown:uncultivated organism
  REGION 1..168: note = MG18-95 HNH domain

SEQ ID NO: 5083 - protein, 168 aa, unidentified; identical to SEQ ID NO: 5056
  REGION 1..168: note = Description of Unknown:uncultivated organism with predicted taxonomy: Clostridium sp.CAG:964
  REGION 1..168: note = MG18-96 HNH domain

SEQ ID NO: 5084 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-97 HNH domain

SEQ ID NO: 5085 - protein, 168 aa, unidentified; identical to SEQ ID NO: 5015
  REGION 1..168: note = Description of Unknown:uncultivated organism with predicted taxonomy:Phascolarctobacterium succinatutens
  REGION 1..168: note = MG18-98 HNH domain

SEQ ID NO: 5086 - protein, 168 aa, unidentified; identical to SEQ ID NO: 4992
  REGION 1..168: note = Description of Unknown:uncultivated organism with predicted taxonomy: Firmicutes
  REGION 1..168: note = MG18-99 HNH domain

SEQ ID NO: 5087 - protein, 168 aa, unidentified; identical to SEQ ID NO: 4998
  REGION 1..168: note = Description of Unknown:uncultivated organism with predicted taxonomy:Phascolarctobacterium succinatutens
  REGION 1..168: note = MG18-100 HNH domain

SEQ ID NO: 5088 - protein, 168 aa, unidentified
  REGION 1..168: note = Description of Unknown:uncultivated organism with predicted taxonomy: Firmicutes
  REGION 1..168: note = MG18-101 HNH domain
SKEESKRTDSRLKKLQDLYKKCKEENIDFMPRKDEFNALKTQLSSKKEDDLRSDKLYLYYTQMGCCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQL

SEQ ID NO: 5089 - protein, 168 aa, unidentified
  REGION 1..168: note = Description of Unknown:uncultivated organism with predicted taxonomy: Firmicutes
  REGION 1..168: note = MG18-102 HNH domain
SKEESKRTDSRLKKLQDLYKKCREENIDFMPRKDEFNALKTQLSSKKEDDLRSDKLYLYYTQMGRCMYTGESIELASLYDNNLYDIDHIYPRSKTKDDSLSNRVLVKKQVNAAKTDIYPLDAAIRTKMHSFWKLLYDKGFIDERKYERLMRSTQLRDEELAGFISRQL

SEQ ID NO: 5090 - protein, 168 aa, unidentified
  REGION 1..168: note = Description of Unknown:uncultivated organism with predicted taxonomy:Phascolarctobacterium succinatutens
  REGION 1..168: note = MG18-103 HNH domain
SKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5091 - protein, 168 aa, unidentified; identical to SEQ ID NO: 4998
  REGION 1..168: note = Description of Unknown:uncultivated organism with predicted taxonomy:Phascolarctobacterium
  REGION 1..168: note = MG18-104 HNH domain

SEQ ID NO: 5092 - protein, 168 aa, unidentified; identical to SEQ ID NO: 4998
  REGION 1..168: note = Description of Unknown:uncultivated organism with predicted taxonomy:Phascolarctobacterium succinatutens
  REGION 1..168: note = MG18-105 HNH domain

SEQ ID NO: 5093 - protein, 168 aa, unidentified; identical to SEQ ID NO: 4996
  REGION 1..168: note = Description of Unknown:uncultivated organism with predicted taxonomy: Firmicutes
  REGION 1..168: note = MG18-106 HNH domain

SEQ ID NO: 5094 - protein, 168 aa, unidentified
  REGION 1..168: note = Description of Unknown:uncultivated organism with predicted taxonomy:Phascolarctobacterium succinatutens
  REGION 1..168: note = MG18-107 HNH domain
SKEESKRTDSRLKKLQDLYKKCREENIDFMPRKDEFNAFKTQLSSKKEEDLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5095 - protein, 168 aa, unidentified; identical to SEQ ID NO: 4991
  REGION 1..168: note = Description of Unknown:uncultivated organism with predicted taxonomy: Ruminococcaceaebacterium
  REGION 1..168: note = MG18-108 HNH domain

SEQ ID NO: 5096 - protein, 168 aa, unidentified
  REGION 1..168: note = Description of Unknown:uncultivated organism with predicted taxonomy:Phascolarctobacterium succinatutens
  REGION 1..168: note = MG18-109 HNH domain
SKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELVGFISRQL

SEQ ID NO: 5097 - protein, 75 aa, unidentified
  REGION 1..75: note = Description of Unknown:uncultivated organism with predicted taxonomy: Clostridialesbacterium
  REGION 1..75: note = MG18-110 HNH domain
SKEESKRTDSRLKKLQDLYKKCREENIDFMPRKDEFNALKTQLSSKKEENLRSDKLYLYYTQMGRCMYTGERLSL

SEQ ID NO: 5098 - protein, 168 aa, unidentified; identical to SEQ ID NO: 4992
  REGION 1..168: note = Description of Unknown:uncultivated organism with predicted taxonomy:Phascolarctobacterium succinatutens
  REGION 1..168: note = MG18-111 HNH domain

SEQ ID NO: 5099 - protein, 168 aa, unidentified; identical to SEQ ID NO: 5074
  REGION 1..168: note = Description of Unknown:uncultivated organism with predicted taxonomy:Phascolarctobacterium succinatutens
  REGION 1..168: note = MG18-112 HNH domain

SEQ ID NO: 5100 - protein, 168 aa, unidentified
  REGION 1..168: note = Description of Unknown:uncultivated organism with predicted taxonomy: Clostridiales
  REGION 1..168: note = MG18-113 HNH domain
SKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5101 - protein, 168 aa, unidentified
  REGION 1..168: note = Description of Unknown:uncultivated organism with predicted taxonomy:Phascolarctobacterium
  REGION 1..168: note = MG18-114 HNH domain
SKEESKRTDSRLKKLQDLYKKCREENIDFMPRKDEFNVLKTQLSSKNEEDLRSDKLYLYYTQMGRCMYTGEIIELASLNDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5102 - protein, 168 aa, unidentified; identical to SEQ ID NO: 5038
  REGION 1..168: note = Description of Unknown:uncultivated organism with predicted taxonomy:Phascolarctobacterium succinatutens
  REGION 1..168: note = MG18-115 HNH domain

SEQ ID NO: 5103 - protein, 168 aa, unidentified; identical to SEQ ID NO: 5015
  REGION 1..168: note = Description of Unknown:uncultivated organism with predicted taxonomy:Phascolarctobacterium succinatutens
  REGION 1..168: note = MG18-116 HNH domain

SEQ ID NO: 5104 - protein, 168 aa, unidentified; identical to SEQ ID NO: 5011
  REGION 1..168: note = Description of Unknown:uncultivated organism with predicted taxonomy:Phascolarctobacterium
  REGION 1..168: note = MG18-117 HNH domain

SEQ ID NO: 5105 - protein, 168 aa, unidentified
  REGION 1..168: note = Description of Unknown:uncultivated organism with predicted taxonomy:Phascolarctobacterium succinatutens
  REGION 1..168: note = MG18-118 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKILYDKGFIDERKYQRLTRSTQLRDEELAGFISRQL

SEQ ID NO: 5106 - protein, 168 aa, unidentified; identical to SEQ ID NO: 5016
  REGION 1..168: note = Description of Unknown:uncultivated organism with predicted taxonomy:Phascolarctobacterium succinatutens
  REGION 1..168: note = MG18-119 HNH domain

SEQ ID NO: 5107 - protein, 168 aa, unidentified; identical to SEQ ID NO: 5056
  REGION 1..168: note = Description of Unknown:uncultivated organism with predicted taxonomy:Phascolarctobacterium succinatutens
  REGION 1..168: note = MG18-120 HNH domain

SEQ ID NO: 5108 - protein, 168 aa, unidentified; identical to SEQ ID NO: 5038
  REGION 1..168: note = Description of Unknown:uncultivated organism with predicted taxonomy:Phascolarctobacterium succinatutens
  REGION 1..168: note = MG18-121 HNH domain

SEQ ID NO: 5109 - protein, 168 aa, unidentified
  REGION 1..168: note = Description of Unknown:uncultivated organism with predicted taxonomy:Phascolarctobacterium
  REGION 1..168: note = MG18-122 HNH domain
SKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQL

SEQ ID NO: 5110 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-123 HNH domain

SEQ ID NO: 5111 - protein, 168 aa, unidentified
  REGION 1..168: note = Description of Unknown:uncultivated organism with predicted taxonomy:Phascolarctobacterium succinatutens
  REGION 1..168: note = MG18-124 HNH domain
SKEESKRTDSRLKKLQDLYKKCREENIDFMPRKDEFNALKTMLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5112 - protein, 168 aa, unidentified; identical to SEQ ID NO: 5026
  REGION 1..168: note = Description of Unknown:uncultivated organism with predicted taxonomy:Phascolarctobacterium
  REGION 1..168: note = MG18-125 HNH domain

SEQ ID NO: 5113 - protein, 168 aa, unidentified; identical to SEQ ID NO: 5100
  REGION 1..168: note = Description of Unknown:uncultivated organism with predicted taxonomy:Phascolarctobacterium
  REGION 1..168: note = MG18-126 HNH domain

SEQ ID NO: 5114 - protein, 168 aa, unidentified; identical to SEQ ID NO: 5071
  REGION 1..168: note = Description of Unknown:uncultivated organism with predicted taxonomy:Phascolarctobacterium
  REGION 1..168: note = MG18-127 HNH domain

SEQ ID NO: 5115 - protein, 168 aa, unidentified
  REGION 1..168: note = Description of Unknown:uncultivated organism with predicted taxonomy:Phascolarctobacterium
  REGION 1..168: note = MG18-128 HNH domain
SKEESKRTDSRLKKLQDLYKQCREENIDFMPHTDELNAFKIQLSSKKEDDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5116 - protein, 168 aa, unidentified
  REGION 1..168: note = Description of Unknown:uncultivated organism with predicted taxonomy:Phascolarctobacterium succinatutens
  REGION 1..168: note = MG18-129 HNH domain
SKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5117 - protein, 168 aa, unidentified
  REGION 1..168: note = Description of Unknown:uncultivated organism with predicted taxonomy:Phascolarctobacterium succinatutens
  REGION 1..168: note = MG18-130 HNH domain
SKEESKRTDSRLKKLQDLYKKCREENIDFMPRKDEFNTLKTQLNSKKEDDLRRDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 5118 - protein, 168 aa, unidentified; identical to SEQ ID NO: 5015
  REGION 1..168: note = Description of Unknown:uncultivated organism with predicted taxonomy:Phascolarctobacterium succinatutens
  REGION 1..168: note = MG18-131 HNH domain

SEQ ID NO: 5119 - protein, 168 aa, unidentified; identical to SEQ ID NO: 5056
  REGION 1..168: note = Description of Unknown:uncultivated organism with predicted taxonomy:Phascolarctobacterium succinatutens
  REGION 1..168: note = MG18-132 HNH domain

SEQ ID NO: 5120 - protein, 168 aa, unidentified; identical to SEQ ID NO: 5109
  REGION 1..168: note = Description of Unknown:uncultivated organism with predicted taxonomy:Phascolarctobacterium succinatutens
  REGION 1..168: note = MG18-133 HNH domain

SEQ ID NO: 5121 - protein, 162 aa, unidentified
  REGION 1..162: note = Description of Unknown:uncultivated organism with predicted taxonomy: Clostridiales
  REGION 1..162: note = MG18-135 HNH domain
GASPEQKNKRTVSRKDQLLALYKACKEDARDWCSELEALPEDKLRSDKLYLYYTQMGRCMYSGELIRLDDLMHDTANQLYDIDHIYPQSKTKDDSLTNRVLVKRQLNAIKSNDYPLPQAMRQTALWKALLEKGLISKQKYLRLTRTTPFTGEELAGFINRQL

SEQ ID NO: 5122 - protein, 162 aa, unidentified
  REGION 1..162: note = Description of Unknown:uncultivated organism with predicted taxonomy: Clostridiales
  REGION 1..162: note = MG18-136 HNH domain
GASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQL

SEQ ID NO: 5123 - protein, 162 aa, unidentified; identical to SEQ ID NO: 5122
  REGION 1..162: note = Description of Unknown:uncultivated organism with predicted taxonomy: Dorea sp.OM02-2LB
  REGION 1..162: note = MG18-137 HNH domain

SEQ ID NO: 5124 - protein, 168 aa, unidentified
  REGION 1..168: note = Description of Unknown:uncultivated organism with predicted taxonomy:Phascolarctobacterium
  REGION 1..168: note = MG18-138 HNH domain
SKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5125 - protein, 168 aa, unidentified
  REGION 1..168: note = Description of Unknown:uncultivated organism with predicted taxonomy:Phascolarctobacterium succinatutens
  REGION 1..168: note = MG18-139 HNH domain
SKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5126 - protein, 168 aa, unidentified; identical to SEQ ID NO: 5125
  REGION 1..168: note = Description of Unknown:uncultivated organism with predicted taxonomy:Phascolarctobacterium succinatutens
  REGION 1..168: note = MG18-140 HNH domain

SEQ ID NO: 5127 - protein, 168 aa, unidentified
  REGION 1..168: note = Description of Unknown:uncultivated organism with predicted taxonomy: Firmicutes
  REGION 1..168: note = MG18-141 HNH domain
SKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQL

SEQ ID NO: 5128 - protein, 168 aa, unidentified; identical to SEQ ID NO: 5056
  REGION 1..168: note = Description of Unknown:uncultivated organism with predicted taxonomy: Clostridium sp.CAG:964
  REGION 1..168: note = MG18-142 HNH domain

SEQ ID NO: 5129 - protein, 162 aa, unidentified; identical to SEQ ID NO: 5121
  REGION 1..162: note = Description of Unknown:uncultivated organism with predicted taxonomy: Clostridiales
  REGION 1..162: note = MG18-143 HNH domain

SEQ ID NO: 5130 - protein, 162 aa, unidentified; identical to SEQ ID NO: 5122
  REGION 1..162: note = Description of Unknown:uncultivated organism with predicted taxonomy: Firmicutes
  REGION 1..162: note = MG18-144 HNH domain

SEQ ID NO: 5131 - protein, 162 aa, unidentified; identical to SEQ ID NO: 5122
  REGION 1..162: note = Description of Unknown:uncultivated organism with predicted taxonomy: Dorea sp.OM02-2LB
  REGION 1..162: note = MG18-145 HNH domain

SEQ ID NO: 5132 - protein, 168 aa, unidentified; identical to SEQ ID NO: 5125
  REGION 1..168: note = Description of Unknown:uncultivated organism with predicted taxonomy:Phascolarctobacterium succinatutens
  REGION 1..168: note = MG18-146 HNH domain

SEQ ID NO: 5133 - protein, 168 aa, unidentified; identical to SEQ ID NO: 5125
  REGION 1..168: note = Description of Unknown:uncultivated organism with predicted taxonomy: Firmicutes
  REGION 1..168: note = MG18-147 HNH domain

SEQ ID NO: 5134 - protein, 168 aa, unidentified
  REGION 1..168: note = Description of Unknown:uncultivated organism with predicted taxonomy: Lactobacillusoryzae
  REGION 1..168: note = MG18-148 HNH domain
SKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQL

SEQ ID NO: 5135 - protein, 168 aa, unidentified; identical to SEQ ID NO: 5017
  REGION 1..168: note = Description of Unknown:uncultivated organism with predicted taxonomy:Phascolarctobacterium
  REGION 1..168: note = MG18-149 HNH domain

SEQ ID NO: 5136 - protein, 168 aa, unidentified
  REGION 1..168: note = Description of Unknown:uncultivated organism with predicted taxonomy: Firmicutes
  REGION 1..168: note = MG18-150 HNH domain
SKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVNKEVNAAKTDIYPLDAAIRTKMHSFWKLLYDKGFIDERKYERLTRSTQLRDEELAGFISRQL

SEQ ID NO: 5137 - protein, 168 aa, unidentified
  REGION 1..168: note = Description of Unknown:uncultivated organism with predicted taxonomy:Phascolarctobacterium
  REGION 1..168: note = MG18-151 HNH domain
SKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5138 - protein, 168 aa, unidentified; identical to SEQ ID NO: 5017
  REGION 1..168: note = Description of Unknown:uncultivated organism with predicted taxonomy:Phascolarctobacterium succinatutens
  REGION 1..168: note = MG18-152 HNH domain

SEQ ID NO: 5139 - protein, 168 aa, unidentified; identical to SEQ ID NO: 5124
  REGION 1..168: note = Description of Unknown:uncultivated organism with predicted taxonomy: Firmicutes
  REGION 1..168: note = MG18-153 HNH domain

SEQ ID NO: 5140 - protein, 168 aa, unidentified; identical to SEQ ID NO: 5011
  REGION 1..168: note = Description of Unknown:uncultivated organism with predicted taxonomy:Phascolarctobacterium succinatutens
  REGION 1..168: note = MG18-154 HNH domain

SEQ ID NO: 5141 - protein, 168 aa, unidentified; identical to SEQ ID NO: 4996
  REGION 1..168: note = Description of Unknown:uncultivated organism with predicted taxonomy:Phascolarctobacterium succinatutens
  REGION 1..168: note = MG18-155 HNH domain

SEQ ID NO: 5142 - protein, 168 aa, unidentified; identical to SEQ ID NO: 5127
  REGION 1..168: note = Description of Unknown:uncultivated organism with predicted taxonomy: Clostridium sp.CAG:964
  REGION 1..168: note = MG18-156 HNH domain

SEQ ID NO: 5143 - protein, 168 aa, unidentified
  REGION 1..168: note = Description of Unknown:uncultivated organism with predicted taxonomy: Ruminococcaceaebacterium
  REGION 1..168: note = MG18-157 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5144 - protein, 168 aa, unidentified; identical to SEQ ID NO: 4996
  REGION 1..168: note = Description of Unknown:uncultivated organism with predicted taxonomy: Clostridium sp.CAG:964
  REGION 1..168: note = MG18-158 HNH domain

SEQ ID NO: 5145 - protein, 168 aa, unidentified; identical to SEQ ID NO: 5026
  REGION 1..168: note = Description of Unknown:uncultivated organism with predicted taxonomy:Phascolarctobacterium succinatutens
  REGION 1..168: note = MG18-159 HNH domain

SEQ ID NO: 5146 - protein, 158 aa, unidentified
  REGION 1..158: note = Description of Unknown:uncultivated organism with predicted taxonomy: Clostridiales
  REGION 1..158: note = MG18-160 HNH domain
GPGEKKRTVSRKDALIELYKTLKSDERDWINEIAVQPEDRFRSDRLYFYYLQLGKCLYTGKPIDLDQIYNEMVYDVDHIYPQSKVKDDSLVNRVLVDSTKNKEKSDRYPIDKEIRDRMKPFWKMLLQQGFMEKEKYERLTRSTPFSDNELAEFIARQL

SEQ ID NO: 5147 - protein, 158 aa, unidentified
  REGION 1..158: note = Description of Unknown:uncultivated organism with predicted taxonomy: Firmicutes
  REGION 1..158: note = MG21-1 HNH domain
EMGKNFKDRGKIAKSQADHAAKNERIKAQISEYKSDHITGQDIVKFKLFKEQDGICLYSGKSLDIARLFEPGYVDVDHIIPYSISFDDSYNNKVLVLSSENRQKGNRIPYAYFGQNSDRWEKYETLVSNTVRSYRKRKNLLLKSLSEAQIDGFKQRNL

SEQ ID NO: 5148 - protein, 160 aa, unidentified
  REGION 1..160: note = Description of Unknown:uncultivated organism with predicted taxonomy: Roseburia sp.AM23-20
  REGION 1..160: note = MG21-3 HNH domain
DMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNL

SEQ ID NO: 5149 - protein, 160 aa, unidentified; identical to SEQ ID NO: 5148
  REGION 1..160: note = Description of Unknown:uncultivated organism with predicted taxonomy: Clostridiales
  REGION 1..160: note = MG21-4 HNH domain

SEQ ID NO: 5150 - protein, 160 aa, unidentified; identical to SEQ ID NO: 5148
  REGION 1..160: note = Description of Unknown:uncultivated organism
  REGION 1..160: note = MG21-5 HNH domain

SEQ ID NO: 5151 - protein, 160 aa, unidentified; identical to SEQ ID NO: 5148
  REGION 1..160: note = Description of Unknown:uncultivated organism
  REGION 1..160: note = MG21-6 HNH domain

SEQ ID NO: 5152 - protein, 157 aa, unidentified
  REGION 1..157: note = Description of Unknown:uncultivated organism with predicted taxonomy: Clostridium sp.CAG:571
  REGION 1..157: note = MG21-7 HNH domain
ELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNL

SEQ ID NO: 5153 - protein, 159 aa, unidentified
  REGION 1..159: note = Description of Unknown:uncultivated organism with predicted taxonomy: Clostridiales
  REGION 1..159: note = MG21-8 HNH domain
EMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNL

SEQ ID NO: 5154 - protein, 160 aa, unidentified
  REGION 1..160: note = Description of Unknown:uncultivated organism
  REGION 1..160: note = MG21-9 HNH domain
DMKRNFTDRQDIKKKQDSNWSYNDKIREKVEELKGSAATGQDIVKMKLYEEQDGYCLYSGKQLDIRRLFEVGYAEVDHIVPYSKCFDDSYNNKVLVFSSENQRKGNRLPLEYMLAEGDEDKLDDYVTLVEARIKNTRKKQRLLKPCLTAEDSNDWKERNL

SEQ ID NO: 5155 - protein, 157 aa, unidentified
  REGION 1..157: note = Description of Unknown:uncultivated organism with predicted taxonomy: Clostridiales
  REGION 1..157: note = MG21-10 HNH domain
ELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNVEEYEIRVNTLIRNNKKKQNLLRQDFTREDAEDWKERNL

SEQ ID NO: 5156 - protein, 157 aa, unidentified
  REGION 1..157: note = Description of Unknown:uncultivated organism with predicted taxonomy: Clostridiales
  REGION 1..157: note = MG21-11 HNH domain
ELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDSEDWKERNL

SEQ ID NO: 5157 - protein, 160 aa, unidentified
  REGION 1..160: note = Description of Unknown:uncultivated organism with predicted taxonomy: Helicobactersp. MIT 11-5569
  REGION 1..160: note = MG21-12 HNH domain
DMKRNFADRQDIKKKQDNNWSCNDRIRQKVEEYKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNL

SEQ ID NO: 5158 - protein, 157 aa, unidentified
  REGION 1..157: note = Description of Unknown:uncultivated organism with predicted taxonomy: Clostridium
  REGION 1..157: note = MG21-13 HNH domain
EMGKNFNDRSKIKKSQEENMQRNENIRQAIIELGKSNPTGQDIVKYKLWQEQDNFCVYSGKKITVDMLFTEAVDVDHIIPYSMCFDDTYNNKVLVLASENRQKGNRVPYKYEKEIGRNIDEYVVRVGNIIKNPKKLRRLLREDFTKEDAKDWKNRNI

SEQ ID NO: 5159 - protein, 157 aa, unidentified
  REGION 1..157: note = Description of Unknown:uncultivated organism with predicted taxonomy: Clostridiales
  REGION 1..157: note = MG21-14 HNH domain
ELGKSFKERQSIEKIYEENRTRNEKAIQEIRELGKTNVTGKDIVKYKLWKDQNEICIYSGKHIKVEDLFTDAVDIDHIIPYSQCFDDTYKNKVLVLASENRQKGNRTAYKYIKEAGKNLEEYEVRVNNYIKDYRKKERLLKADFSTEDAKNWKDRNI

SEQ ID NO: 5160 - protein, 157 aa, unidentified
  REGION 1..157: note = Description of Unknown:uncultivated organism
  REGION 1..157: note = MG21-15 HNH domain
EMGRNFKDRNIIKKSQEINMKNNEFVKERIVELGKENPRGQDIVKYKLWQEQDGVCIYSGKKIPIENLFTEAVDVDHIIPYSMCFDDTYNNKVLVLASENRQKGNRVPYKYEKEIGRDIEEYEVRVNNIIKNPYKRVKLLREDFTREDALEWKDRNI

SEQ ID NO: 5161 - protein, 160 aa, unidentified
  REGION 1..160: note = Description of Unknown:uncultivated organism
  REGION 1..160: note = MG21-16 HNH domain
DMKRNFTDRQDIKKKQDNNWSYNDRIRQKVEELKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNL

SEQ ID NO: 5162 - protein, 158 aa, unidentified
  REGION 1..158: note = Description of Unknown:uncultivated organism with predicted taxonomy: Clostridiales
  REGION 1..158: note = MG21-17 HNH domain
EMSQNFDDRRKAEKRQEENRAANERVKEQIAEYKGDRATGLDIVKFKLYREQDGVCLYSGKNLDIGRLFEPGYADVDHIIPYSRCFDDSYQNKVLVLASENRQKGNRLPYEYFGQDETRWHEYEVRVENLIRNYRKRQKLLKKQLTEEESTGFIDRNL

SEQ ID NO: 5163 - protein, 158 aa, unidentified
  REGION 1..158: note = Description of Unknown:uncultivated organism with predicted taxonomy: Clostridialesbacterium 42_27
  REGION 1..158: note = MG21-18 HNH domain
EMSRNFDDRRKAEKRQEENRAANERAKEQIVEYKGDCATGLDIVKFKLYREQDGVCLYSGQNLDLSRLFEPGYVDVDHIIPYSRCFDDSYQNKTLVLASENRQKGNRLPYEYFGQDEARWHEYEVRVENLIRNYRKRQRLLKKRLTEDESAGFIDRNL

SEQ ID NO: 5164 - protein, 182 aa, unidentified
  REGION 1..182: note = Description of Unknown:uncultivated organism
  REGION 1..182: note = MG21-19 HNH domain
DIKCGSRTRERIAQENEANRERREKLINEVENIKKQKHCEKVNATEQEILKLQLYKDQHGKCLYSGKELDKDKVISESGYAEIDHIIPYSQSFDNSEANKVLTLSEENRNKGNDVPVAYILRKHKNSEKEYDAFVKRVKSVTKEVSNTNKDRQKILEKRKQNLLISPNFKVDELEGLLVRET

SEQ ID NO: 5165 - protein, 158 aa, unidentified; identical to SEQ ID NO: 5162
  REGION 1..158: note = Description of Unknown:uncultivated organism with predicted taxonomy: Clostridiales
  REGION 1..158: note = MG21-20 HNH domain

SEQ ID NO: 5166 - protein, 157 aa, unidentified
  REGION 1..157: note = Description of Unknown:uncultivated organism with predicted taxonomy: Clostridialesbacterium 42_27
  REGION 1..157: note = MG21-21 HNH domain
ELGKNFADRKAIEKRQNDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNL

SEQ ID NO: 5167 - protein, 158 aa, unidentified
  REGION 1..158: note = Description of Unknown:uncultivated organism with predicted taxonomy: Clostridiales
  REGION 1..158: note = MG21-22 HNH domain
EMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5168 - protein, 159 aa, unidentified
  REGION 1..159: note = Description of Unknown:uncultivated organism with predicted taxonomy: Roseburiainulinivorans
  REGION 1..159: note = MG21-23 HNH domain
EMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNL

SEQ ID NO: 5169 - protein, 159 aa, unidentified
  REGION 1..159: note = Description of Unknown:uncultivated organism with predicted taxonomy: Firmicutes
  REGION 1..159: note = MG21-24 HNH domain
EMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAEENRQKGNRTPYEYFGADEQRWHEFSARVRASVRDFKKRQKLLNTSFGEEQKNEFTQRNL

SEQ ID NO: 5170 - protein, 158 aa, unidentified
  REGION 1..158: note = Description of Unknown:uncultivated organism with predicted taxonomy: Clostridialesbacterium 42_27
  REGION 1..158: note = MG21-25 HNH domain
EMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5171 - protein, 158 aa, unidentified; identical to SEQ ID NO: 5170
  REGION 1..158: note = Description of Unknown:uncultivated organism with predicted taxonomy: Ruminococcaceaebacterium TF06-43
  REGION 1..158: note = MG21-26 HNH domain

SEQ ID NO: 5172 - protein, 158 aa, unidentified
  REGION 1..158: note = Description of Unknown:uncultivated organism with predicted taxonomy: Clostridiales
  REGION 1..158: note = MG21-27 HNH domain
EMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNL

SEQ ID NO: 5173 - protein, 158 aa, unidentified
  REGION 1..158: note = Description of Unknown:uncultivated organism with predicted taxonomy: Clostridialesbacterium 42_27
  REGION 1..158: note = MG21-28 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5174 - protein, 158 aa, unidentified
  REGION 1..158: note = Description of Unknown:uncultivated organism with predicted taxonomy: Firmicutes
  REGION 1..158: note = MG21-29 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGNDDVRWHEYEVRVENLIRNYRKRQKLLKRQLSEEESAGFIDRNL

SEQ ID NO: 5175 - protein, 158 aa, unidentified; identical to SEQ ID NO: 5170
  REGION 1..158: note = Description of Unknown:uncultivated organism with predicted taxonomy: Clostridialesbacterium 42_27
  REGION 1..158: note = MG21-30 HNH domain

SEQ ID NO: 5176 - protein, 159 aa, unidentified
  REGION 1..159: note = Description of Unknown:uncultivated organism
  REGION 1..159: note = MG21-31 HNH domain
EMHHSIKERNRMKKRQEENREKNEQVKAQILETKPGTRVTGLDIVKFKLYQEQDGICLYSGKPLEIERLYEPGYAEVDHIIPYSRCFDDSYSNKVLVLAEENQQKGNCTPYEYFGADEQRWHEFSVRVGASVRDFKKRQKLLNTSFGEEQGKDFIQRNL

SEQ ID NO: 5177 - protein, 158 aa, unidentified
  REGION 1..158: note = Description of Unknown:uncultivated organism with predicted taxonomy: Ruminococcaceaebacterium TF06-43
  REGION 1..158: note = MG21-32 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNL

SEQ ID NO: 5178 - protein, 158 aa, unidentified
  REGION 1..158: note = Description of Unknown:uncultivated organism with predicted taxonomy: Clostridiales
  REGION 1..158: note = MG21-33 HNH domain
EMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNL

SEQ ID NO: 5179 - protein, 158 aa, unidentified
  REGION 1..158: note = Description of Unknown:uncultivated organism with predicted taxonomy: Clostridiales
  REGION 1..158: note = MG21-34 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNL

SEQ ID NO: 5180 - protein, 158 aa, unidentified
  REGION 1..158: note = Description of Unknown:uncultivated organism with predicted taxonomy: Clostridiales
  REGION 1..158: note = MG21-35 HNH domain
EMSRTFDERRKMEKRQDDNRAANERAKNQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5181 - protein, 157 aa, unidentified
  REGION 1..157: note = Description of Unknown:uncultivated organism
  REGION 1..157: note = MG21-36 HNH domain
ELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNKIPYQYMQEKGRDLDEYEIRVNNIIKNYSKKQRLLKQKFTREDANEWKDRNI

SEQ ID NO: 5182 - protein, 158 aa, unidentified
  REGION 1..158: note = Description of Unknown:uncultivated organism with predicted taxonomy: Clostridiales
  REGION 1..158: note = MG21-37 HNH domain
EMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5183 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-38 HNH domain

SEQ ID NO: 5184 - protein, 158 aa, unidentified
  REGION 1..158: note = Description of Unknown:uncultivated organism with predicted taxonomy: Clostridiales
  REGION 1..158: note = MG21-39 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNL

SEQ ID NO: 5185 - protein, 158 aa, unidentified
  REGION 1..158: note = Description of Unknown:uncultivated organism with predicted taxonomy: Clostridiales
  REGION 1..158: note = MG21-40 HNH domain
EMSQNFEKRRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDEARWHGYEVRVENLIRNYRKRQKLLKKRLTEEESAGFIDRNL

SEQ ID NO: 5186 - protein, 159 aa, unidentified
  REGION 1..159: note = Description of Unknown:uncultivated organism with predicted taxonomy: Firmicutes
  REGION 1..159: note = MG21-41 HNH domain
EMSHSFDERNKMKKRQEDGWQKNEQVKAQILETKTGTRVTGLDIVKFKLYQEQDGICLYSGTPMEIERLYEPGYADVDHIIPYSRCFDDSYSNKVLVLASENRQKGNRTPYEYFGANEQRWHEFSVRVGASVRDFKKRQKLLNTSFGEEQGKEFIQRNL

SEQ ID NO: 5187 - protein, 157 aa, unidentified
  REGION 1..157: note = Description of Unknown:uncultivated organism with predicted taxonomy: Clostridiales
  REGION 1..157: note = MG21-42 HNH domain
ELGKNFADRRTIEKRQSDNTQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNSKKKQNLLRQDFTREDAEDWKERNL

SEQ ID NO: 5188 - protein, 158 aa, unidentified
  REGION 1..158: note = Description of Unknown:uncultivated organism with predicted taxonomy: Clostridialesbacterium 42_27
  REGION 1..158: note = MG21-43 HNH domain
EMSRTFDERRKMEKRQDDNRAANKRAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5189 - protein, 157 aa, unidentified
  REGION 1..157: note = Description of Unknown:uncultivated organism with predicted taxonomy: Clostridiales
  REGION 1..157: note = MG21-44 HNH domain
QLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNI

SEQ ID NO: 5190 - protein, 158 aa, unidentified; identical to SEQ ID NO: 5170
  REGION 1..158: note = Description of Unknown:uncultivated organism with predicted taxonomy: Clostridiales
  REGION 1..158: note = MG21-45 HNH domain

SEQ ID NO: 5191 - protein, 157 aa, unidentified; identical to SEQ ID NO: 5187
  REGION 1..157: note = Description of Unknown:uncultivated organism with predicted taxonomy: Clostridiales
  REGION 1..157: note = MG21-46 HNH domain

SEQ ID NO: 5192 - protein, 158 aa, unidentified; identical to SEQ ID NO: 5172
  REGION 1..158: note = Description of Unknown:uncultivated organism with predicted taxonomy: Clostridiales
  REGION 1..158: note = MG21-47 HNH domain

SEQ ID NO: 5193 - protein, 158 aa, unidentified; identical to SEQ ID NO: 5182
  REGION 1..158: note = Description of Unknown:uncultivated organism with predicted taxonomy: Clostridialesbacterium 42_27
  REGION 1..158: note = MG21-48 HNH domain

SEQ ID NO: 5194 - protein, 158 aa, unidentified
  REGION 1..158: note = Description of Unknown:uncultivated organism with predicted taxonomy: Clostridialesbacterium 42_27
  REGION 1..158: note = MG21-49 HNH domain
EMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5195 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-50 HNH domain

SEQ ID NO: 5196 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-51 HNH domain

SEQ ID NO: 5197 - protein, 158 aa, unidentified
  REGION 1..158: note = Description of Unknown:uncultivated organism with predicted taxonomy: Clostridialesbacterium 42_27
  REGION 1..158: note = MG21-52 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5198 - protein, 158 aa, unidentified
  REGION 1..158: note = Description of Unknown:uncultivated organism with predicted taxonomy: Clostridiales
  REGION 1..158: note = MG21-53 HNH domain
EMGKPYDVRTQITKKQEANAKKNEELRQQIKKIKGAEPTGQDIVKFKLFQEQKGVCLYSGQNLDITRLFEAGYVDVDHIVPYSISFDDSYTNKVLVRSPENRQKGNRIPADYFKSDPARWQRFETLVNTRVHNWKKKRNLLTQALSEEQKNGFKQRNL

SEQ ID NO: 5199 - protein, 158 aa, unidentified
  REGION 1..158: note = Description of Unknown:uncultivated organism with predicted taxonomy: Clostridiales
  REGION 1..158: note = MG21-54 HNH domain
EMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5200 - protein, 159 aa, unidentified
  REGION 1..159: note = Description of Unknown:uncultivated organism with predicted taxonomy: Ruminococcaceaebacterium TF06-43
  REGION 1..159: note = MG21-55 HNH domain
EMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAKENQQKGNCTPYEYFGADEQRWHEFSARVRASVRDFKKRQKLLNTSFGEEQGKEFIQRNL

SEQ ID NO: 5201 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-56 HNH domain

SEQ ID NO: 5202 - protein, 158 aa, unidentified
  REGION 1..158: note = Description of Unknown:uncultivated organism
  REGION 1..158: note = MG21-57 HNH domain
EMGKNFKDRRMIETRQTDNAAKNERIKAQISEYKSDHITGQDIVKFKLFKEQDGICLYSGKSLNIARLFEPGYVDIDHIIPYSISFDDSYNNKVLVLSSENRQKGNRIPYAYFGQNSDRWEKYETLVNNTVRSYRKRKNLLLKSLSEAQIDGFKQRNL

SEQ ID NO: 5203 - protein, 158 aa, unidentified
  REGION 1..158: note = Description of Unknown:uncultivated organism with predicted taxonomy: Oscillibactersp. CAG:241_62_21
  REGION 1..158: note = MG21-58 HNH domain
EMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNL

SEQ ID NO: 5204 - protein, 158 aa, unidentified; identical to SEQ ID NO: 5203
  REGION 1..158: note = Description of Unknown:uncultivated organism with predicted taxonomy: Clostridiales
  REGION 1..158: note = MG21-59 HNH domain

SEQ ID NO: 5205 - protein, 158 aa, unidentified; identical to SEQ ID NO: 5173
  REGION 1..158: note = Description of Unknown:uncultivated organism with predicted taxonomy: Firmicutes
  REGION 1..158: note = MG21-60 HNH domain

SEQ ID NO: 5206 - protein, 158 aa, unidentified; identical to SEQ ID NO: 5179
  REGION 1..158: note = Description of Unknown:uncultivated organism with predicted taxonomy: Clostridiales
  REGION 1..158: note = MG21-61 HNH domain

SEQ ID NO: 5207 - protein, 158 aa, unidentified; identical to SEQ ID NO: 5182
  REGION 1..158: note = Description of Unknown:uncultivated organism with predicted taxonomy: Firmicutesbacterium CAG:129
  REGION 1..158: note = MG21-62 HNH domain

SEQ ID NO: 5208 - protein, 158 aa, unidentified; identical to SEQ ID NO: 5184
  REGION 1..158: note = Description of Unknown:uncultivated organism with predicted taxonomy: Clostridiales
  REGION 1..158: note = MG21-63 HNH domain

SEQ ID NO: 5209 - protein, 158 aa, unidentified; identical to SEQ ID NO: 5184
  REGION 1..158: note = Description of Unknown:uncultivated organism with predicted taxonomy: Clostridiales
  REGION 1..158: note = MG21-64 HNH domain

SEQ ID NO: 5210 - protein, 158 aa, unidentified; identical to SEQ ID NO: 5172
  REGION 1..158: note = Description of Unknown:uncultivated organism with predicted taxonomy: Clostridialesbacterium 42_27
  REGION 1..158: note = MG21-65 HNH domain

SEQ ID NO: 5211 - protein, 158 aa, unidentified; identical to SEQ ID NO: 5184
  REGION 1..158: note = Description of Unknown:uncultivated organism with predicted taxonomy: Clostridiales
  REGION 1..158: note = MG21-66 HNH domain

SEQ ID NO: 5212 - protein, 158 aa, unidentified; identical to SEQ ID NO: 5174
  REGION 1..158: note = Description of Unknown:uncultivated organism with predicted taxonomy: Clostridia
  REGION 1..158: note = MG21-67 HNH domain

SEQ ID NO: 5213 - protein, 158 aa, unidentified; identical to SEQ ID NO: 5194
  REGION 1..158: note = Description of Unknown:uncultivated organism with predicted taxonomy: Clostridiales
  REGION 1..158: note = MG21-68 HNH domain

SEQ ID NO: 5214 - protein, 159 aa, unidentified
  REGION 1..159: note = Description of Unknown:uncultivated organism with predicted taxonomy: Firmicutes
  REGION 1..159: note = MG21-69 HNH domain
EMHHSIKERNRMKKRQEENREKNEQVKAQILETKPGTRVTGLDIVKFKLHQEQKGFCPYSGVEIKKERLYEPGYAEVDHIIPYSRCFDDSYSNKVLVLAEENRQKGNRTPYEYFGADEQRWHEFSARVRASVQDFKKRQKLLNTSFGEEQKNEFTQRNL

SEQ ID NO: 5215 - protein, 159 aa, unidentified
  REGION 1..159: note = Description of Unknown:uncultivated organism with predicted taxonomy: Firmicutes
  REGION 1..159: note = MG21-70 HNH domain
EMSHSFDERNKMKKRQEDGWRKNEQVKAQILETKTGNRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNL

SEQ ID NO: 5216 - protein, 159 aa, unidentified; identical to SEQ ID NO: 5169
  REGION 1..159: note = Description of Unknown:uncultivated organism with predicted taxonomy: Clostridiales
  REGION 1..159: note = MG21-71 HNH domain

SEQ ID NO: 5217 - protein, 159 aa, unidentified; identical to SEQ ID NO: 5168
  REGION 1..159: note = Description of Unknown:uncultivated organism
  REGION 1..159: note = MG21-72 HNH domain

SEQ ID NO: 5218 - protein, 158 aa, unidentified; identical to SEQ ID NO: 5177
  REGION 1..158: note = Description of Unknown:uncultivated organism with predicted taxonomy: Clostridiales
  REGION 1..158: note = MG21-73 HNH domain

SEQ ID NO: 5219 - protein, 159 aa, unidentified
  REGION 1..159: note = Description of Unknown:uncultivated organism with predicted taxonomy: Firmicutes
  REGION 1..159: note = MG21-74 HNH domain
EMSHSFDERNKIKKRQEDGRRKNEQIKAQILETKAGHRVTGLDIVKFKLFQEQDGVCPYSGKALDVQRLYEPGYADVDHIIPYSRCFDDSYSNKVLVLASENRQKGNCTPYEYFGADERRWHEFSVRVGASVRDFKKRQKLLNTSFGEEQGKEFIQRNL

SEQ ID NO: 5220 - protein, 157 aa, unidentified
  REGION 1..157: note = Description of Unknown:uncultivated organism with predicted taxonomy: Clostridiales
  REGION 1..157: note = MG21-75 HNH domain
ELSKNFADRQNIKKNQENNMQSNEKAKEDILKLGKSNPTGQDIVKYKLWKEQDGICVYSGKRISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNI

SEQ ID NO: 5221 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-76 HNH domain

SEQ ID NO: 5222 - protein, 158 aa, unidentified
  REGION 1..158: note = Description of Unknown:uncultivated organism with predicted taxonomy: Clostridiales
  REGION 1..158: note = MG21-77 HNH domain
EMGKPYDVRTQITKKQEANAKKNEEVKQKIREIKGLEPTGQDIVKFKLFQDQNGVCLYSGQSLDITRLFEAGYVDVDHIIPYSISFDDSYTNKVLVRSPENRQKGNRIPADYFKSDPARWQRFETLVNTRVHNWKKKRNLLTQALSEEQKNGFKQRNL

SEQ ID NO: 5223 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-78 HNH domain

SEQ ID NO: 5224 - protein, 158 aa, unidentified; identical to SEQ ID NO: 5199
  REGION 1..158: note = Description of Unknown:uncultivated organism with predicted taxonomy: Clostridiales
  REGION 1..158: note = MG21-79 HNH domain

SEQ ID NO: 5225 - protein, 158 aa, unidentified
  REGION 1..158: note = Description of Unknown:uncultivated organism with predicted taxonomy: Clostridiales
  REGION 1..158: note = MG21-80 HNH domain
EMGKNFKDRRMIETRQTDNAAKNERIKAQISEYKSDHITGQDIVKFKLFKEQDGICLYSGKSLDIARLFEPGYVDIDHIIPYSISFDDSYNNKVLVQSSENRQKGNRIPYAYFGQNSDRWEKYETLVNNTVRSYRKRKNLLLKSLSEAQIDGFKQRNL

SEQ ID NO: 5226 - protein, 158 aa, unidentified
  REGION 1..158: note = Description of Unknown:uncultivated organism with predicted taxonomy: Clostridiales
  REGION 1..158: note = MG21-81 HNH domain
EMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNL

SEQ ID NO: 5227 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-82 HNH domain

SEQ ID NO: 5228 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-83 HNH domain

SEQ ID NO: 5229 - protein, 158 aa, unidentified; identical to SEQ ID NO: 5184
  REGION 1..158: note = Description of Unknown:uncultivated organism with predicted taxonomy: Clostridiales
  REGION 1..158: note = MG21-84 HNH domain

SEQ ID NO: 5230 - protein, 158 aa, unidentified
  REGION 1..158: note = Description of Unknown:uncultivated organism with predicted taxonomy: Clostridiales
  REGION 1..158: note = MG21-85 HNH domain
EMGKSKADRDKIDAEQKANAKRNEELRQQIKKIKGAEPTGQDIVKFKLFQDQNGVCLYSGQNLDITRLFEAGYVEIDHIIPYSISLDNSYANKVLVLKEENQNKGRRTPYEYFGADSKRWQRFETLVNTQVHNWKKKRNLLTQALSEEQKNGFKQRNL

SEQ ID NO: 5231 - protein, 158 aa, unidentified; identical to SEQ ID NO: 5226
  REGION 1..158: note = Description of Unknown:uncultivated organism with predicted taxonomy: Firmicutes
  REGION 1..158: note = MG21-86 HNH domain

SEQ ID NO: 5232 - protein, 158 aa, unidentified; identical to SEQ ID NO: 5179
  REGION 1..158: note = Description of Unknown:uncultivated organism with predicted taxonomy: Clostridiales
  REGION 1..158: note = MG21-87 HNH domain

SEQ ID NO: 5233 - protein, 158 aa, unidentified; identical to SEQ ID NO: 5178
  REGION 1..158: note = Description of Unknown:uncultivated organism with predicted taxonomy: Clostridiales
  REGION 1..158: note = MG21-88 HNH domain

SEQ ID NO: 5234 - protein, 158 aa, unidentified; identical to SEQ ID NO: 5179
  REGION 1..158: note = Description of Unknown:uncultivated organism with predicted taxonomy: Clostridiales
  REGION 1..158: note = MG21-89 HNH domain

SEQ ID NO: 5235 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-90 HNH domain

SEQ ID NO: 5236 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-91 HNH domain

SEQ ID NO: 5237 - protein, 158 aa, unidentified; identical to SEQ ID NO: 5179
  REGION 1..158: note = Description of Unknown:uncultivated organism with predicted taxonomy: Ruminococcaceaebacterium TF06-43
  REGION 1..158: note = MG21-92 HNH domain

SEQ ID NO: 5238 - protein, 158 aa, unidentified; identical to SEQ ID NO: 5179
  REGION 1..158: note = Description of Unknown:uncultivated organism with predicted taxonomy: Ruminococcaceaebacterium TF06-43
  REGION 1..158: note = MG21-93 HNH domain

SEQ ID NO: 5239 - protein, 158 aa, unidentified; identical to SEQ ID NO: 5184
  REGION 1..158: note = Description of Unknown:uncultivated organism with predicted taxonomy: Clostridiales
  REGION 1..158: note = MG21-94 HNH domain

SEQ ID NO: 5240 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-95 HNH domain

SEQ ID NO: 5241 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-96 HNH domain

SEQ ID NO: 5242 - protein, 157 aa, unidentified; identical to SEQ ID NO: 5189
  REGION 1..157: note = Description of Unknown:uncultivated organism with predicted taxonomy: Clostridium
  REGION 1..157: note = MG21-97 HNH domain

SEQ ID NO: 5243 - protein, 160 aa, unidentified
  REGION 1..160: note = Description of Unknown:uncultivated organism with predicted taxonomy: Clostridiales
  REGION 1..160: note = MG21-98 HNH domain
EMGKSKADRDKIDAEQKANAKRNEELRQQIKKIKGAEPTGQDIVKFKLFQEQKGVCLYSGKNIEIDRLFKPEAGYVEIDHIIPYSISLDNSYANKVLVLKEENQNKGRRTPYEYFGADSKRWQRFETLVNTQVHNWKKKRNLLTQALSEEQKNGFKQRNL

SEQ ID NO: 5244 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-99 HNH domain

SEQ ID NO: 5245 - protein, 158 aa, unidentified
  REGION 1..158: note = Description of Unknown:uncultivated organism with predicted taxonomy: Clostridiales
  REGION 1..158: note = MG21-100 HNH domain
EMSRNFDERRKAEKRQDENRAANERAKEQIAEYKGDHATGLDIVKFKLYQEQDGVYLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNL

SEQ ID NO: 5246 - protein, 157 aa, unidentified
  REGION 1..157: note = Description of Unknown:uncultivated organism with predicted taxonomy: Clostridiales
  REGION 1..157: note = MG21-101 HNH domain
ELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNI

SEQ ID NO: 5247 - protein, 157 aa, unidentified; identical to SEQ ID NO: 5189
  REGION 1..157: note = Description of Unknown:uncultivated organism with predicted taxonomy: Clostridium
  REGION 1..157: note = MG21-102 HNH domain

SEQ ID NO: 5248 - protein, 158 aa, unidentified
  REGION 1..158: note = Description of Unknown:uncultivated organism with predicted taxonomy: Clostridiales
  REGION 1..158: note = MG21-103 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNL

SEQ ID NO: 5249 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-104 HNH domain

SEQ ID NO: 5250 - protein, 158 aa, unidentified; identical to SEQ ID NO: 5197
  REGION 1..158: note = Description of Unknown:uncultivated organism with predicted taxonomy: Clostridialesbacterium 42_27
  REGION 1..158: note = MG21-105 HNH domain

SEQ ID NO: 5251 - protein, 158 aa, unidentified; identical to SEQ ID NO: 5203
  REGION 1..158: note = Description of Unknown:uncultivated organism with predicted taxonomy: Oscillibactersp. CAG:241_62_21
  REGION 1..158: note = MG21-106 HNH domain

SEQ ID NO: 5252 - protein, 157 aa, unidentified; identical to SEQ ID NO: 5189
  REGION 1..157: note = Description of Unknown:uncultivated organism with predicted taxonomy: Clostridium
  REGION 1..157: note = MG21-107 HNH domain

SEQ ID NO: 5253 - protein, 158 aa, unidentified; identical to SEQ ID NO: 5179
  REGION 1..158: note = Description of Unknown:uncultivated organism with predicted taxonomy: Clostridiales
  REGION 1..158: note = MG21-108 HNH domain

SEQ ID NO: 5254 - protein, 158 aa, unidentified; identical to SEQ ID NO: 5197
  REGION 1..158: note = Description of Unknown:uncultivated organism with predicted taxonomy: Clostridialesbacterium 42_27
  REGION 1..158: note = MG21-109 HNH domain

SEQ ID NO: 5255 - protein, 158 aa, unidentified; identical to SEQ ID NO: 5203
  REGION 1..158: note = Description of Unknown:uncultivated organism with predicted taxonomy: Oscillibactersp. CAG:241_62_21
  REGION 1..158: note = MG21-110 HNH domain

SEQ ID NO: 5256 - protein, 158 aa, unidentified; identical to SEQ ID NO: 5248
  REGION 1..158: note = Description of Unknown:uncultivated organism with predicted taxonomy: Clostridiales
  REGION 1..158: note = MG21-111 HNH domain

SEQ ID NO: 5257 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-112 HNH domain

SEQ ID NO: 5258 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-113 HNH domain

SEQ ID NO: 5259 - protein, 158 aa, unidentified; identical to SEQ ID NO: 5197
  REGION 1..158: note = Description of Unknown:uncultivated organism with predicted taxonomy: Clostridialesbacterium 42_27
  REGION 1..158: note = MG21-114 HNH domain

SEQ ID NO: 5260 - protein, 158 aa, unidentified
  REGION 1..158: note = Description of Unknown:uncultivated organism with predicted taxonomy: Clostridiales
  REGION 1..158: note = MG21-115 HNH domain
EMGKPYDVRTQMTKKQETNAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQVLSEEQKNGFKQRNL

SEQ ID NO: 5261 - protein, 158 aa, unidentified; identical to SEQ ID NO: 5179
  REGION 1..158: note = Description of Unknown:uncultivated organism with predicted taxonomy: Clostridiales
  REGION 1..158: note = MG21-116 HNH domain

SEQ ID NO: 5262 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-117 HNH domain

SEQ ID NO: 5263 - protein, 158 aa, unidentified; identical to SEQ ID NO: 5170
  REGION 1..158: note = Description of Unknown:uncultivated organism with predicted taxonomy: Clostridialesbacterium 42_27
  REGION 1..158: note = MG21-118 HNH domain

SEQ ID NO: 5264 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-119 HNH domain

SEQ ID NO: 5265 - protein, 158 aa, unidentified; identical to SEQ ID NO: 5179
  REGION 1..158: note = Description of Unknown:uncultivated organism with predicted taxonomy: Ruminococcaceaebacterium TF06-43
  REGION 1..158: note = MG21-120 HNH domain

SEQ ID NO: 5266 - protein, 158 aa, unidentified; identical to SEQ ID NO: 5248
  REGION 1..158: note = Description of Unknown:uncultivated organism with predicted taxonomy: Clostridiales
  REGION 1..158: note = MG21-121 HNH domain

SEQ ID NO: 5267 - protein, 159 aa, unidentified; identical to SEQ ID NO: 5214
  REGION 1..159: note = Description of Unknown:uncultivated organism
  REGION 1..159: note = MG21-122 HNH domain

SEQ ID NO: 5268 - protein, 158 aa, unidentified; identical to SEQ ID NO: 5173
  REGION 1..158: note = Description of Unknown:uncultivated organism with predicted taxonomy: Clostridiales
  REGION 1..158: note = MG21-123 HNH domain

SEQ ID NO: 5269 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-124 HNH domain

SEQ ID NO: 5270 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-125 HNH domain

SEQ ID NO: 5271 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-126 HNH domain

SEQ ID NO: 5272 - protein, 158 aa, unidentified
  REGION 1..158: note = Description of Unknown:uncultivated organism with predicted taxonomy: Clostridialesbacterium 42_27
  REGION 1..158: note = MG21-127 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLNEEESTGFIDRNL

SEQ ID NO: 5273 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-128 HNH domain

SEQ ID NO: 5274 - protein, 158 aa, unidentified
  REGION 1..158: note = Description of Unknown:uncultivated organism with predicted taxonomy: Clostridialesbacterium 42_27
  REGION 1..158: note = MG21-129 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIARNL

SEQ ID NO: 5275 - protein, 158 aa, unidentified
  REGION 1..158: note = Description of Unknown:uncultivated organism with predicted taxonomy: Clostridialesbacterium 42_27
  REGION 1..158: note = MG21-130 HNH domain
EMSRTFDERRKMEKRQDDNRAANERAKDQIAEYKGAHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5276 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-131 HNH domain

SEQ ID NO: 5277 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-132 HNH domain

SEQ ID NO: 5278 - protein, 158 aa, unidentified; identical to SEQ ID NO: 5203
  REGION 1..158: note = Description of Unknown:uncultivated organism with predicted taxonomy: Clostridiales
  REGION 1..158: note = MG21-133 HNH domain

SEQ ID NO: 5279 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-134 HNH domain

SEQ ID NO: 5280 - protein, 158 aa, unidentified; identical to SEQ ID NO: 5173
  REGION 1..158: note = Description of Unknown:uncultivated organism with predicted taxonomy: Clostridiales
  REGION 1..158: note = MG21-135 HNH domain

SEQ ID NO: 5281 - protein, 159 aa, unidentified; identical to SEQ ID NO: 5153
  REGION 1..159: note = Description of Unknown:uncultivated organism with predicted taxonomy: Clostridiales
  REGION 1..159: note = MG21-136 HNH domain

SEQ ID NO: 5282 - protein, 157 aa, unidentified; identical to SEQ ID NO: 5246
  REGION 1..157: note = Description of Unknown:uncultivated organism with predicted taxonomy: Clostridiales
  REGION 1..157: note = MG21-137 HNH domain

SEQ ID NO: 5283 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-138 HNH domain

SEQ ID NO: 5284 - protein, 158 aa, unidentified; identical to SEQ ID NO: 5173
  REGION 1..158: note = Description of Unknown:uncultivated organism with predicted taxonomy: Clostridiales
  REGION 1..158: note = MG21-139 HNH domain

SEQ ID NO: 5285 - protein, 158 aa, unidentified; identical to SEQ ID NO: 5194
  REGION 1..158: note = Description of Unknown:uncultivated organism with predicted taxonomy: Clostridialesbacterium 42_27
  REGION 1..158: note = MG21-140 HNH domain

SEQ ID NO: 5286 - protein, 159 aa, unidentified
  REGION 1..159: note = Description of Unknown:uncultivated organism with predicted taxonomy: Firmicutes
  REGION 1..159: note = MG21-141 HNH domain
EMSHSFDERNKMKKRQEDGRQENEQVKAQILETKAGDRVTGLDIVKFKLYREQDGVCLYSGKGLDLQRLYEPGYADVDHIIPYSRCFDDSYSNKVLVLASENRQKGNCTPYEYFGENEQRWHEFSVRVGASVRDFKKRQKLLNTSFGEEQGKNFIQRNL

SEQ ID NO: 5287 - protein, 158 aa, unidentified; identical to SEQ ID NO: 5173
  REGION 1..158: note = Description of Unknown:uncultivated organism with predicted taxonomy: Clostridialesbacterium 42_27
  REGION 1..158: note = MG21-142 HNH domain

SEQ ID NO: 5288 - protein, 158 aa, unidentified; identical to SEQ ID NO: 5197
  REGION 1..158: note = Description of Unknown:uncultivated organism with predicted taxonomy: Clostridialesbacterium 42_27
  REGION 1..158: note = MG21-143 HNH domain

SEQ ID NO: 5289 - protein, 158 aa, unidentified
  REGION 1..158: note = Description of Unknown:uncultivated organism with predicted taxonomy: Clostridiales
  REGION 1..158: note = MG21-144 HNH domain
EMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWKRFETLVNTQVHNWKKKRNLLTQVLSEEQKNGFKQRNL

SEQ ID NO: 5290 - protein, 158 aa, unidentified
  REGION 1..158: note = Description of Unknown:uncultivated organism with predicted taxonomy: Clostridiales
  REGION 1..158: note = MG21-145 HNH domain
ELGKTFDERSKQEKRINENAARNEQAREQIREYKSGDSTGLDIVKFKLFQEQNGVCLYSGKNLDISRLFEAGYVDVDHIIPYSISFDDSYSNKVLVLAGENRQKGNRIPYQYFGNDRERWNRFETLVGTQIRSFKKRKNLLIRSLGEAQIEGFRQRNL

SEQ ID NO: 5291 - protein, 218 aa, unidentified
  REGION 1..218: note = Description of Unknown:uncultivated organism with predicted taxonomy: Bacteroidales
  REGION 1..218: note = MG22-1 HNH domain
DLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEEFSHRQL

SEQ ID NO: 5292 - protein, 229 aa, unidentified
  REGION 1..229: note = Description of Unknown:uncultivated organism with predicted taxonomy: Bacteroidales
  REGION 1..229: note = MG22-3 HNH domain
DLKNTAEQRARIMRRNRENEMTNFRIKLLLQELHDCQPDIEGIRPYSPSQQELLRLYEETVWESESGKLGGKEASKDIPDDIKKIRDLLSKPSDKPIPQSAIQRYRLWLDQKYLSPYTGRPIPLARLFTADYEIEHIIPRSIFFDDSYANKVICESAVNKLKNNRLGMQFIREMDGRVETVKLGEGRETSILSVDGYVDLVNDLFRNNPRKRNNLLAEEITEDFCHRQL

SEQ ID NO: 5293 - protein, 229 aa, unidentified; identical to SEQ ID NO: 5292
  REGION 1..229: note = Description of Unknown:uncultivated organism with predicted taxonomy: Bacteroidales
  REGION 1..229: note = MG22-4 HNH domain

SEQ ID NO: 5294 - protein, 218 aa, unidentified
  REGION 1..218: note = Description of Unknown:uncultivated organism with predicted taxonomy: Bacteroidales
  REGION 1..218: note = MG22-5 HNH domain
DLKNTAEERSRIFRRNSENEDTNFRIKLLLEEFYANEKDIIDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5295 - protein, 218 aa, unidentified
  REGION 1..218: note = Description of Unknown:uncultivated organism with predicted taxonomy: Bacteroidales
  REGION 1..218: note = MG22-6 HNH domain
DLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQL

SEQ ID NO: 5296 - protein, 218 aa, unidentified; identical to SEQ ID NO: 5294
  REGION 1..218: note = Description of Unknown:uncultivated organism with predicted taxonomy: Prevotella
  REGION 1..218: note = MG22-7 HNH domain

SEQ ID NO: 5297 - protein, 218 aa, unidentified; identical to SEQ ID NO: 5295
  REGION 1..218: note = Description of Unknown:uncultivated organism with predicted taxonomy: Bacteroidales
  REGION 1..218: note = MG22-8 HNH domain

SEQ ID NO: 5298 - protein, 218 aa, unidentified
  REGION 1..218: note = Description of Unknown:uncultivated organism with predicted taxonomy: Bacteroidales
  REGION 1..218: note = MG22-9 HNH domain
DLKNTAEERSRIFRRNSENEDTNFRIKLLLEEFYTNEEDMEGIRPYSPSQQELLRIYEEGVWQQEKEIPQDIKDIKKKLSSDKDINEITHSDVQRYRIWMDQKYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQL

SEQ ID NO: 5299 - protein, 218 aa, unidentified
  REGION 1..218: note = Description of Unknown:uncultivated organism with predicted taxonomy: Bacteroidales
  REGION 1..218: note = MG22-10 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5300 - protein, 179 aa, unidentified
  REGION 1..179: note = Description of Unknown:uncultivated organism with predicted taxonomy: Prevotella
  REGION 1..179: note = MG22-11 HNH domain
DLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVL

SEQ ID NO: 5301 - protein, 218 aa, unidentified; identical to SEQ ID NO: 5299
  REGION 1..218: note = Description of Unknown:uncultivated organism with predicted taxonomy: Prevotella sp.MGM2
  REGION 1..218: note = MG22-12 HNH domain

SEQ ID NO: 5302 - protein, 218 aa, unidentified
  REGION 1..218: note = Description of Unknown:uncultivated organism with predicted taxonomy: Prevotella
  REGION 1..218: note = MG22-13 HNH domain
DLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQL

SEQ ID NO: 5303 - protein, 23 aa, unidentified
  REGION 1..23: note = Description of Unknown:uncultivated organism with predicted taxonomy: Bacteroidesndongoniae
  REGION 1..23: note = MG22-14 HNH domain
DLKNTAEERSRIFRRNSENEDTN

SEQ ID NO: 5304 - protein, 218 aa, unidentified
  REGION 1..218: note = Description of Unknown:uncultivated organism with predicted taxonomy: Prevotella sp.MGM2
  REGION 1..218: note = MG22-15 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQL

SEQ ID NO: 5305 - protein, 218 aa, unidentified
  REGION 1..218: note = Description of Unknown:uncultivated organism with predicted taxonomy: Prevotella sp.MGM2
  REGION 1..218: note = MG22-16 HNH domain
DLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQL

SEQ ID NO: 5306 - protein, 218 aa, unidentified; identical to SEQ ID NO: 5304
  REGION 1..218: note = Description of Unknown:uncultivated organism with predicted taxonomy: Prevotella
  REGION 1..218: note = MG22-17 HNH domain

SEQ ID NO: 5307 - protein, 218 aa, unidentified; identical to SEQ ID NO: 5305
  REGION 1..218: note = Description of Unknown:uncultivated organism with predicted taxonomy: Bacteroidales
  REGION 1..218: note = MG22-18 HNH domain

SEQ ID NO: 5308 - protein, 218 aa, unidentified; identical to SEQ ID NO: 5299
  REGION 1..218: note = Description of Unknown:uncultivated organism with predicted taxonomy: Prevotella
  REGION 1..218: note = MG22-19 HNH domain

SEQ ID NO: 5309 - protein, 163 aa, unidentified
  REGION 1..163: note = Description of Unknown:uncultivated organism with predicted taxonomy: Prevotella sp.MGM2
  REGION 1..163: note = MG22-20 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIM

SEQ ID NO: 5310 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-21 HNH domain

SEQ ID NO: 5311 - protein, 218 aa, unidentified; identical to SEQ ID NO: 5302
  REGION 1..218: note = Description of Unknown:uncultivated organism with predicted taxonomy: Bacteroidales
  REGION 1..218: note = MG22-22 HNH domain

SEQ ID NO: 5312 - protein, 217 aa, unidentified
  REGION 1..217: note = Description of Unknown:uncultivated organism with predicted taxonomy: Bacteroidales
  REGION 1..217: note = MG22-23 HNH domain
DLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQL

SEQ ID NO: 5313 - protein, 218 aa, unidentified
  REGION 1..218: note = Description of Unknown:uncultivated organism with predicted taxonomy: Bacteroidales
  REGION 1..218: note = MG22-24 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLANEITEEFSHRQL

SEQ ID NO: 5314 - protein, 218 aa, unidentified; identical to SEQ ID NO: 5299
  REGION 1..218: note = Description of Unknown:uncultivated organism with predicted taxonomy: Prevotella sp.MGM2
  REGION 1..218: note = MG22-25 HNH domain

SEQ ID NO: 5315 - protein, 218 aa, unidentified
  REGION 1..218: note = Description of Unknown:uncultivated organism with predicted taxonomy: Bacteroidales
  REGION 1..218: note = MG22-26 HNH domain
DLKNTAEERSRIFRRNNENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5316 - protein, 218 aa, unidentified; identical to SEQ ID NO: 5299
  REGION 1..218: note = Description of Unknown:uncultivated organism with predicted taxonomy: Prevotella sp.MGM2
  REGION 1..218: note = MG22-27 HNH domain

SEQ ID NO: 5317 - protein, 218 aa, unidentified; identical to SEQ ID NO: 5304
  REGION 1..218: note = Description of Unknown:uncultivated organism with predicted taxonomy: Bacteroidales
  REGION 1..218: note = MG22-28 HNH domain

SEQ ID NO: 5318 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-29 HNH domain

SEQ ID NO: 5319 - protein, 206 aa, unidentified
  REGION 1..206: note = Description of Unknown:uncultivated organism with predicted taxonomy: Prevotella sp.MGM2
  REGION 1..206: note = MG22-30 HNH domain
FRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQL

SEQ ID NO: 5320 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-31 HNH domain

SEQ ID NO: 5321 - protein, 47 aa, unidentified
  REGION 1..47: note = Description of Unknown:uncultivated organism with predicted taxonomy: Bacteroidales
  REGION 1..47: note = MG22-32 HNH domain
DLKNSAAERAKISNRNKQNEGTNFRIKLLLQEFSQYEKDIEGIRRAL

SEQ ID NO: 5322 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-33 HNH domain

SEQ ID NO: 5323 - protein, 216 aa, unidentified
  REGION 1..216: note = Description of Unknown:uncultivated organism with predicted taxonomy: Bacteroidales
  REGION 1..216: note = MG22-34 HNH domain
DLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQL

SEQ ID NO: 5324 - protein, 216 aa, unidentified; identical to SEQ ID NO: 5323
  REGION 1..216: note = Description of Unknown:uncultivated organism with predicted taxonomy: Parabacteroidessp. An277
  REGION 1..216: note = MG22-35 HNH domain

SEQ ID NO: 5325 - protein, 217 aa, unidentified
  REGION 1..217: note = Description of Unknown:uncultivated organism with predicted taxonomy: Bacteroidales
  REGION 1..217: note = MG22-36 HNH domain
DLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMTFIQESGGQIIPLGNGRNVQVLNESAYVEFINKTFKHNARKRSLMLADEITEEFCHRQL

SEQ ID NO: 5326 - protein, 218 aa, unidentified
  REGION 1..218: note = Description of Unknown:uncultivated organism with predicted taxonomy: Bacteroidales
  REGION 1..218: note = MG22-37 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDTYNNKVICESAVNKDKNNRLGMEYIMAAGGKTIELGNGKNVQILKEEEYVELVDKIFGNNTRKRNIMLADEITEDFSHRQL

SEQ ID NO: 5327 - protein, 218 aa, unidentified; identical to SEQ ID NO: 5299
  REGION 1..218: note = Description of Unknown:uncultivated organism with predicted taxonomy: Prevotella
  REGION 1..218: note = MG22-38 HNH domain

SEQ ID NO: 5328 - protein, 218 aa, unidentified
  REGION 1..218: note = Description of Unknown:uncultivated organism with predicted taxonomy: Prevotella sp.MGM2
  REGION 1..218: note = MG22-39 HNH domain
DLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5329 - protein, 216 aa, unidentified
  REGION 1..216: note = Description of Unknown:uncultivated organism with predicted taxonomy: Bacteroidales
  REGION 1..216: note = MG22-40 HNH domain
DLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLSESAYVEFINKTFKHNARKRSLMLADEITEEFCHRQL

SEQ ID NO: 5330 - protein, 218 aa, unidentified
  REGION 1..218: note = Description of Unknown:uncultivated organism with predicted taxonomy: Bacteroidales
  REGION 1..218: note = MG22-41 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQL

SEQ ID NO: 5331 - protein, 218 aa, unidentified; identical to SEQ ID NO: 5313
  REGION 1..218: note = Description of Unknown:uncultivated organism with predicted taxonomy: Prevotella
  REGION 1..218: note = MG22-42 HNH domain

SEQ ID NO: 5332 - protein, 218 aa, unidentified
  REGION 1..218: note = Description of Unknown:uncultivated organism with predicted taxonomy: Bacteroidales
  REGION 1..218: note = MG22-43 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKDVQILKEEEYVELVDKIFGNNTRKRNIMLADEITEEFSHRQL

SEQ ID NO: 5333 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-44 HNH domain

SEQ ID NO: 5334 - protein, 218 aa, unidentified
  REGION 1..218: note = Description of Unknown:uncultivated organism with predicted taxonomy: Bacteroidales
  REGION 1..218: note = MG22-45 HNH domain
DLKNTAEERSRIFRRNSENEDTNFRIKLLLEEFNANEKDIKDVRPYSPSQQELLHIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQL

SEQ ID NO: 5335 - protein, 216 aa, unidentified; identical to SEQ ID NO: 5323
  REGION 1..216: note = Description of Unknown:uncultivated organism with predicted taxonomy: Bacteroidales
  REGION 1..216: note = MG22-46 HNH domain

SEQ ID NO: 5336 - protein, 218 aa, unidentified
  REGION 1..218: note = Description of Unknown:uncultivated organism with predicted taxonomy: Bacteroidales
  REGION 1..218: note = MG22-47 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLADEITEEFSHRQL

SEQ ID NO: 5337 - protein, 216 aa, unidentified; identical to SEQ ID NO: 5323
  REGION 1..216: note = Description of Unknown:uncultivated organism with predicted taxonomy: Bacteroidales
  REGION 1..216: note = MG22-48 HNH domain

SEQ ID NO: 5338 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-49 HNH domain

SEQ ID NO: 5339 - protein, 218 aa, unidentified
  REGION 1..218: note = Description of Unknown:uncultivated organism with predicted taxonomy: Bacteroidales
  REGION 1..218: note = MG22-50 HNH domain
DLKNTAEERSRIFRRNSENEDTNFRIKLLLEEFYANEKDIKDVRPYSPSQQELLRIYEEGVWQKEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5340 - protein, 217 aa, unidentified
  REGION 1..217: note = Description of Unknown:uncultivated organism with predicted taxonomy: Prevotellaceae
  REGION 1..217: note = MG22-51 HNH domain
DLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQL

SEQ ID NO: 5341 - protein, 168 aa, unidentified
  REGION 1..168: note = Description of Unknown:uncultivated organism with predicted taxonomy: Prevotella sp.MGM2
  REGION 1..168: note = MG22-52 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLYNPQNEAFRLS

SEQ ID NO: 5342 - protein, 218 aa, unidentified
  REGION 1..218: note = Description of Unknown:uncultivated organism with predicted taxonomy: Bacteroidales
  REGION 1..218: note = MG22-53 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLTDEITEEFSHRQL

SEQ ID NO: 5343 - protein, 218 aa, unidentified
  REGION 1..218: note = Description of Unknown:uncultivated organism with predicted taxonomy: Bacteroidales
  REGION 1..218: note = MG22-54 HNH domain
DLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQL

SEQ ID NO: 5344 - protein, 218 aa, unidentified; identical to SEQ ID NO: 5343
  REGION 1..218: note = Description of Unknown:uncultivated organism with predicted taxonomy: Bacteroidales
  REGION 1..218: note = MG22-55 HNH domain

SEQ ID NO: 5345 - protein, 218 aa, unidentified
  REGION 1..218: note = Description of Unknown:uncultivated organism with predicted taxonomy: Bacteroidales
  REGION 1..218: note = MG22-56 HNH domain
DLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQL

SEQ ID NO: 5346 - protein, 218 aa, unidentified
  REGION 1..218: note = Description of Unknown:uncultivated organism with predicted taxonomy: Bacteroidales
  REGION 1..218: note = MG22-57 HNH domain
DLKNTAEERSRIFRRNSENEDTNFRIKLLLEEFNANEKDIKDVRPYSPSRQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5347 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-58 HNH domain

SEQ ID NO: 5348 - protein, 218 aa, unidentified; identical to SEQ ID NO: 5302
  REGION 1..218: note = Description of Unknown:uncultivated organism with predicted taxonomy: Bacteroidales
  REGION 1..218: note = MG22-59 HNH domain

SEQ ID NO: 5349 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-60 HNH domain

SEQ ID NO: 5350 - protein, 218 aa, unidentified
  REGION 1..218: note = Description of Unknown:uncultivated organism with predicted taxonomy: Bacteroidales
  REGION 1..218: note = MG22-61 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILMEEEYVELVDKIFGNNTRKRNIMLADEITEEFSHRQL

SEQ ID NO: 5351 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-62 HNH domain

SEQ ID NO: 5352 - protein, 155 aa, unidentified
  REGION 1..155: note = Description of Unknown:uncultivated organism with predicted taxonomy: Parabacteroides
  REGION 1..155: note = MG22-63 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNN

SEQ ID NO: 5353 - protein, 218 aa, unidentified
  REGION 1..218: note = Description of Unknown:uncultivated organism with predicted taxonomy: Prevotella sp.MGM2
  REGION 1..218: note = MG22-64 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5354 - protein, 218 aa, unidentified; identical to SEQ ID NO: 5353
  REGION 1..218: note = Description of Unknown:uncultivated organism with predicted taxonomy: Prevotella
  REGION 1..218: note = MG22-65 HNH domain

SEQ ID NO: 5355 - protein, 218 aa, unidentified; identical to SEQ ID NO: 5299
  REGION 1..218: note = Description of Unknown:uncultivated organism with predicted taxonomy: Prevotella sp.MGM2
  REGION 1..218: note = MG22-66 HNH domain

SEQ ID NO: 5356 - protein, 180 aa, unidentified
  REGION 1..180: note = Description of Unknown:uncultivated organism with predicted taxonomy: Bacteroidales
  REGION 1..180: note = MG22-67 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTAKRYHCPVFSPPTTKSNTSFRVHGILTTPIIIRSSAKLPSTKTKTTDWAWNTSWLLEEKRLNSATGKTFKF

SEQ ID NO: 5357 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-68 HNH domain

SEQ ID NO: 5358 - protein, 218 aa, unidentified; identical to SEQ ID NO: 5353
  REGION 1..218: note = Description of Unknown:uncultivated organism with predicted taxonomy: Bacteroidales
  REGION 1..218: note = MG22-69 HNH domain

SEQ ID NO: 5359 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-70 HNH domain

SEQ ID NO: 5360 - protein, 217 aa, unidentified; identical to SEQ ID NO: 5340
  REGION 1..217: note = Description of Unknown:uncultivated organism with predicted taxonomy: Bacteroidales
  REGION 1..217: note = MG22-71 HNH domain

SEQ ID NO: 5361 - protein, 218 aa, unidentified
  REGION 1..218: note = Description of Unknown:uncultivated organism with predicted taxonomy: Bacteroidales
  REGION 1..218: note = MG22-72 HNH domain
DLKNTAEERSRIFRRNSENEDTNFRIKLLLEKFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5362 - protein, 218 aa, unidentified; identical to SEQ ID NO: 5305
  REGION 1..218: note = Description of Unknown:uncultivated organism with predicted taxonomy: Prevotella sp.MGM2
  REGION 1..218: note = MG22-73 HNH domain

SEQ ID NO: 5363 - protein, 218 aa, unidentified; identical to SEQ ID NO: 5305
  REGION 1..218: note = Description of Unknown:uncultivated organism with predicted taxonomy: Bacteroidales
  REGION 1..218: note = MG22-74 HNH domain

SEQ ID NO: 5364 - protein, 218 aa, unidentified
  REGION 1..218: note = Description of Unknown:uncultivated organism with predicted taxonomy: Bacteroidales
  REGION 1..218: note = MG22-75 HNH domain
DLKNTAEERARISKRNSENEDTNFRIKLLLKEFYTNEEDMEGIRPYSPSQQELLRIYEEGVWQQEKEIPQDIKDIKKKLSSDKDINEITHSDVQRYRIWMDQEYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQL

SEQ ID NO: 5365 - protein, 218 aa, unidentified
  REGION 1..218: note = Description of Unknown:uncultivated organism with predicted taxonomy: Bacteroidales
  REGION 1..218: note = MG22-76 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEDFSHRQL

SEQ ID NO: 5366 - protein, 218 aa, unidentified; identical to SEQ ID NO: 5299
  REGION 1..218: note = Description of Unknown:uncultivated organism with predicted taxonomy: Prevotella
  REGION 1..218: note = MG22-77 HNH domain

SEQ ID NO: 5367 - protein, 218 aa, unidentified; identical to SEQ ID NO: 5302
  REGION 1..218: note = Description of Unknown:uncultivated organism with predicted taxonomy: Bacteroidales
  REGION 1..218: note = MG22-78 HNH domain

SEQ ID NO: 5368 - protein, 218 aa, unidentified
  REGION 1..218: note = Description of Unknown:uncultivated organism with predicted taxonomy: Bacteroidales
  REGION 1..218: note = MG22-79 HNH domain
DLKNTAEERSRIFRRNSENEDTNFRIKLLLEEFYANEKDIKDVRPYSPSQQELLRIYEEGVWQQEKDIPQDIKDIRKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQL

SEQ ID NO: 5369 - protein, 218 aa, unidentified; identical to SEQ ID NO: 5299
  REGION 1..218: note = Description of Unknown:uncultivated organism with predicted taxonomy: Bacteroidales
  REGION 1..218: note = MG22-80 HNH domain

SEQ ID NO: 5370 - protein, 217 aa, unidentified; identical to SEQ ID NO: 5340
  REGION 1..217: note = Description of Unknown:uncultivated organism with predicted taxonomy: Bacteroidales
  REGION 1..217: note = MG22-81 HNH domain

SEQ ID NO: 5371 - protein, 218 aa, unidentified; identical to SEQ ID NO: 5353
  REGION 1..218: note = Description of Unknown:uncultivated organism with predicted taxonomy: Prevotella
  REGION 1..218: note = MG22-82 HNH domain

SEQ ID NO: 5372 - protein, 218 aa, unidentified; identical to SEQ ID NO: 5353
  REGION 1..218: note = Description of Unknown:uncultivated organism with predicted taxonomy: Prevotella
  REGION 1..218: note = MG22-83 HNH domain

SEQ ID NO: 5373 - protein, 218 aa, unidentified; identical to SEQ ID NO: 5330
  REGION 1..218: note = Description of Unknown:uncultivated organism with predicted taxonomy: Bacteroidales
  REGION 1..218: note = MG22-84 HNH domain

SEQ ID NO: 5374 - protein, 218 aa, unidentified; identical to SEQ ID NO: 5299
  REGION 1..218: note = Description of Unknown:uncultivated organism with predicted taxonomy: Prevotella
  REGION 1..218: note = MG22-85 HNH domain

SEQ ID NO: 5375 - protein, 218 aa, unidentified
  REGION 1..218: note = Description of Unknown:uncultivated organism with predicted taxonomy: Bacteroidales
  REGION 1..218: note = MG22-86 HNH domain
DLKNTAEERSRIFRRNSENEETNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAINKDKNNRLGMEYIMAAGGKTIELGNGKDVQILKEEEYVELVDKIFGNNTRKRNIMLADEITEEFSHRQL

SEQ ID NO: 5376 - protein, 218 aa, unidentified
  REGION 1..218: note = Description of Unknown:uncultivated organism with predicted taxonomy: Prevotella sp.MGM2
  REGION 1..218: note = MG22-87 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSQRQL

SEQ ID NO: 5377 - protein, 218 aa, unidentified
  REGION 1..218: note = Description of Unknown:uncultivated organism with predicted taxonomy: Prevotella sp.MGM2
  REGION 1..218: note = MG22-88 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQL

SEQ ID NO: 5378 - protein, 218 aa, unidentified
  REGION 1..218: note = Description of Unknown:uncultivated organism with predicted taxonomy: Prevotella sp.MGM2
  REGION 1..218: note = MG22-89 HNH domain
DLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5379 - protein, 218 aa, unidentified; identical to SEQ ID NO: 5304
  REGION 1..218: note = Description of Unknown:uncultivated organism with predicted taxonomy: Bacteroidales
  REGION 1..218: note = MG22-90 HNH domain

SEQ ID NO: 5380 - protein, 218 aa, unidentified; identical to SEQ ID NO: 5377
  REGION 1..218: note = Description of Unknown:uncultivated organism with predicted taxonomy: Prevotella
  REGION 1..218: note = MG22-91 HNH domain

SEQ ID NO: 5381 - protein, 218 aa, unidentified; identical to SEQ ID NO: 5302
  REGION 1..218: note = Description of Unknown:uncultivated organism with predicted taxonomy: Bacteroidales
  REGION 1..218: note = MG22-92 HNH domain

SEQ ID NO: 5382 - protein, 217 aa, unidentified
  REGION 1..217: note = Description of Unknown:uncultivated organism with predicted taxonomy: Prevotella
  REGION 1..217: note = MG22-94 HNH domain
NMRATAKERQKTSQLQLENEQANLRIKALLQEFMNPEFEVEDVRPYSPSQQELLRIYEGTVLEQEAGHIDEPIREIIRKFSQTDAAKRPTTSEVLRYKLWLEQKYRSPYTGEVIPLGKLFTPAYQIEHVIPQSLYYDNSFNNKVICEAEVNLLKGNQLGMPFIMRHANEKVVCSMGKQVKIFTPEAYRLFVEEHYRGRKMTILLSEEIPTAFNDRQK

SEQ ID NO: 5383 - protein, 227 aa, unidentified
  REGION 1..227: note = Description of Unknown:uncultivated organism with predicted taxonomy: Bacteroidales
  REGION 1..227: note = MG22-95 HNH domain
SVKQNKEQRERAMTQMAENERRNLRLRAMLEAFLNDRDPIGFDPDANINPGSPNQQLKLRLFEDTAFSYAQANGDDQVEEMLNIRNSITGGSDEKSATPAQIRRYALWLEQNFRSPYTGATISLARLFTDDYQVDHIIPQALYWDDSFNNKVLCEGGVNNTKSNALAFDFIAAHQGETIALPNGRKVTILSMEQYQELVLATYKNNRAKCEKLLMKEIPAEFTQRQL

SEQ ID NO: 5384 - protein, 219 aa, unidentified
  REGION 1..219: note = Description of Unknown:uncultivated organism with predicted taxonomy: Bacteroidales
  REGION 1..219: note = MG22-96 HNH domain
NLNQTAEQRKRDTERNLGNERANLRAKILLTEFLNPEMNVENVRPYSPSQLELLRIFEEGILDDSAGNMPDDIQEIIKKLDSTDIKRRPTESEVLRYRNWLEQGYRSPYTNEIIPLSKLFTTAYQIEHIIPQSLYFNNSYNNKVICEAEVNQLKSNQLGMEFVKNHGGEIVECAFGRKVRILTPEEYTAFVEQHYKHNVHKKNNLLSTELPSEFSSRQL

SEQ ID NO: 5385 - protein, 219 aa, unidentified
  REGION 1..219: note = Description of Unknown:uncultivated organism with predicted taxonomy: Bacteroidetes
  REGION 1..219: note = MG22-97 HNH domain
NLNQTAEQRKRDTERNLGNERANLRAKILLTEFLNPEMNVENVRPYSPSQQELLRIFEEGIIDDSTGNMPDDIQEIIKKLDSSDIKRRPTESEILRYRNWLEQGYRSPYTNEIIPLSKLFTPAYQIEHIIPQSLYFNNSYNNKVICETEVNQLKSNQLGMEFVKNHGGEIVECAFGRKVRILTPEEYTAFVEQHYKHNIHKKNNLLSTELPSEFSSRQL

SEQ ID NO: 5386 - protein, 176 aa, unidentified
  REGION 1..176: note = Description of Unknown:uncultivated organism with predicted taxonomy: Bacteroidales
  REGION 1..176: note = MG22-98 HNH domain
SMKQTSQQRKADNERMQSNYKRNQEVRDKIAEELQQNATNGERPKIGAKKIASYKIWEDQKGRSPYTGKAISDAALLNADGRYDIDHVIPQSRYYDDSLNNKVICEKEVNLKKGNMLGLEFIQKHGGETIQLSSGGEVTILREEEDKKLVNETFKGRKQKIMLMTETPNDFTNRQK

SEQ ID NO: 5387 - protein, 220 aa, unidentified
  REGION 1..220: note = Description of Unknown:uncultivated organism with predicted taxonomy:Flavobacteriales
  REGION 1..220: note = MG22-99 HNH domain
DMRKTAQERKRDSERNSQNFKARQRIKMLLDEFEKMRIDDVHPYSPMHQEKLRIVEDGVFDRVSAKGDEKSKEMLKDMRAFQTNVEKNNVTPGDISRYMLYLEQNYRSPYTNETISMKRLFSSDYEIEHVIPRSRFFDDSMSNKVICEAKVNKEKGNMTGMEFIMKRGGEKIELGEGREVTIVNEKDYRQYVDEVYKNNSRKRKNLLSEDIPGGFSNSQM

SEQ ID NO: 5388 - protein, 217 aa, unidentified
  REGION 1..217: note = Description of Unknown:uncultivated organism with predicted taxonomy: Bacteroidales
  REGION 1..217: note = MG22-100 HNH domain
EMRATAKEREERSARQLRNEQTNLRIKALLQEFMNPALEIEDVRPYSPSQQELLHIYEETVLEQEAGNIDDDIREIIRKFTQTEASKRPTEGEVRRYKLWLEQRYRSPYTGKNIPLGKLFTPAYQIEHVIPQSVYYDNSYNNKVICEAEVNLLKGNMLGMAFIKEHAGEIVPLSLGGEVEILKPDTYREFVEEHYKGRKRQIMLSEEIPTEFTSRQM

SEQ ID NO: 5389 - protein, 217 aa, unidentified
  REGION 1..217: note = Description of Unknown:uncultivated organism with predicted taxonomy: Bacteroidales
  REGION 1..217: note = MG22-101 HNH domain
EMRATAKERESRHNRQLENEQTNLRIKALLQEFMNPEFGIEDVRPYSPNQQELLRIYEDTVLSQEAGRVDEPIREIIRKFSQTDAAKRPTTAEVLRYKLWLEQKYRSPYTGEPISLSKIFTSAYQIEHVIPQSVYYDNSYSNKVICEAEVNLLKGNMLGMPFIMQHAGEKVQCSVGNIVTISTPEAYRAFVEEHYKGKKQKILLSEEIPTNFTARQM

SEQ ID NO: 5390 - protein, 164 aa, unidentified
  REGION 1..164: note = Description of Unknown:uncultivated organism with predicted taxonomy: Clostridia
  REGION 1..164: note = MG23-1 HNH domain
EDGEKGARTVSRKKKLLDLYDAIKHEERELAKVFSDEIDSKTEADFRSKKLYLYYLQQGRCMYSGDIIHLSDLMNDNLYDIDHIYPRHFIKDDSLENNLVLVKKQINNRKQDTFPIERSIQEDMRPFWKSLADSGFISAEKYKRLTRRDAFTDEEKAAFISRQL

SEQ ID NO: 5391 - protein, 162 aa, unidentified
  REGION 1..162: note = Description of Unknown:uncultivated organism with predicted taxonomy: Firmicutes
  REGION 1..162: note = MG23-3 HNH domain
DDAQTKAKNKGKRTKSRKDFLLECYKDDKAWKDELTSVDDGELRAKKLYLYYLQMGRCMYSGEAIDLASLMSGNTMYDIDHIHPRHFVKDDSLENNLVLVKKDKNAHKSDNYPLESEIRNKQFGFWKSLLDKGLITKTKFTRLIRSEDFSPEELAGFINRQL

SEQ ID NO: 5392 - protein, 160 aa, unidentified
  REGION 1..160: note = Description of Unknown:uncultivated organism with predicted taxonomy: Clostridiales
  REGION 1..160: note = MG23-4 HNH domain
EDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQL

SEQ ID NO: 5393 - protein, 166 aa, unidentified
  REGION 1..166: note = Description of Unknown:uncultivated organism with predicted taxonomy: Firmicutes
  REGION 1..166: note = MG23-5 HNH domain
DSAQTRARNKGKRTQSRKEFLLNVYKEDKEWRKEIQSCEEIKFRKKKIYLYYLQHGKSLYSGKTIDFDTLLSDNDAYDIDHIYPRHFVKDDSLENNLVLCLKSENAKKGDQYPLRKTFDSAVLSSQEGVWKSLLKQKVITKEKYDRLVRTADFTIDELAGFINRQL

SEQ ID NO: 5394 - protein, 162 aa, unidentified
  REGION 1..162: note = Description of Unknown:uncultivated organism with predicted taxonomy: Clostridiales
  REGION 1..162: note = MG23-6 HNH domain
DSAQTRARNKGKRTQSRKDFLINAYKEDKEWRKEIESRDEAEFRIKKLYLYYVQMGRCMYSGEAIDLHALMAGNEQYDIDHIYPRHFVKDDSLENNLVLVKKTINAHKSDTFPLEAELRKKQYAFWRSLLDRGLITQNKFNRLTRATGFSNEELAGFINRQL

SEQ ID NO: 5395 - protein, 160 aa, unidentified; identical to SEQ ID NO: 5392
  REGION 1..160: note = Description of Unknown:uncultivated organism with predicted taxonomy: Clostridiales
  REGION 1..160: note = MG23-7 HNH domain

SEQ ID NO: 5396 - protein, 160 aa, unidentified; identical to SEQ ID NO: 5392
  REGION 1..160: note = Description of Unknown:uncultivated organism with predicted taxonomy: Clostridiales
  REGION 1..160: note = MG23-8 HNH domain

SEQ ID NO: 5397 - protein, 160 aa, unidentified; identical to SEQ ID NO: 5392
  REGION 1..160: note = Description of Unknown:uncultivated organism with predicted taxonomy: Clostridiales
  REGION 1..160: note = MG23-9 HNH domain

SEQ ID NO: 5398 - protein, 165 aa, unidentified
  REGION 1..165: note = Description of Unknown:uncultivated organism with predicted taxonomy: Clostridiales
  REGION 1..165: note = MG23-10 HNH domain
EHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5399 - protein, 164 aa, unidentified
  REGION 1..164: note = Description of Unknown:uncultivated organism with predicted taxonomy: Butyrivibriosp. CAG:318
  REGION 1..164: note = MG23-11 HNH domain
EHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQL

SEQ ID NO: 5400 - protein, 164 aa, unidentified
  REGION 1..164: note = Description of Unknown:uncultivated organism with predicted taxonomy: Butyrivibriosp. CAG:318
  REGION 1..164: note = MG23-12 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQL

SEQ ID NO: 5401 - protein, 165 aa, unidentified
  REGION 1..165: note = Description of Unknown:uncultivated organism with predicted taxonomy: Clostridium sp.AF36-4
  REGION 1..165: note = MG23-13 HNH domain
EHESGNERKASRKKKMLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5402 - protein, 164 aa, unidentified
  REGION 1..164: note = Description of Unknown:uncultivated organism with predicted taxonomy: Butyrivibriosp. CAG:318
  REGION 1..164: note = MG23-14 HNH domain
EHGKENDRKTSRKKKILDLYSALKREKKEWAELKIREIEGRTEADFRIKKLYLYYLQQGRCMYSGEKIELNDLFNNNLYDIDHIYPRHFIKDDSLENNLVLVKKEINNHKSDNYPLESDIRKNMNEFWKSLREKNFISKEKYSRLIRTEEFTDEEKAAFISRQL

SEQ ID NO: 5403 - protein, 164 aa, unidentified
  REGION 1..164: note = Description of Unknown:uncultivated organism with predicted taxonomy: Butyrivibriosp. CAG:318
  REGION 1..164: note = MG23-15 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQL

SEQ ID NO: 5404 - protein, 165 aa, unidentified; identical to SEQ ID NO: 5401
  REGION 1..165: note = Description of Unknown:uncultivated organism with predicted taxonomy: Clostridium sp.AF36-4
  REGION 1..165: note = MG23-16 HNH domain

SEQ ID NO: 5405 - protein, 164 aa, unidentified
  REGION 1..164: note = Description of Unknown:uncultivated organism with predicted taxonomy: Butyrivibriosp. CAG:318
  REGION 1..164: note = MG23-17 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQL

SEQ ID NO: 5406 - protein, 165 aa, unidentified
  REGION 1..165: note = Description of Unknown:uncultivated organism with predicted taxonomy: Clostridiales
  REGION 1..165: note = MG23-18 HNH domain
EHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5407 - protein, 164 aa, unidentified; identical to SEQ ID NO: 5402
  REGION 1..164: note = Description of Unknown:uncultivated organism with predicted taxonomy: Butyrivibriosp. CAG:318
  REGION 1..164: note = MG23-19 HNH domain

SEQ ID NO: 5408 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-20 HNH domain

SEQ ID NO: 5409 - protein, 164 aa, unidentified
  REGION 1..164: note = Description of Unknown:uncultivated organism with predicted taxonomy: Butyrivibriosp. CAG:318
  REGION 1..164: note = MG23-21 HNH domain
EHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESDIRKNMNEFWKSLREKNFISKEKYSRLIRTEEFTDEEKAAFISRQL

SEQ ID NO: 5410 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-22 HNH domain

SEQ ID NO: 5411 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-23 HNH domain

SEQ ID NO: 5412 - protein, 165 aa, unidentified
  REGION 1..165: note = Description of Unknown:uncultivated organism with predicted taxonomy: Clostridiales
  REGION 1..165: note = MG23-24 HNH domain
EHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5413 - protein, 164 aa, unidentified
  REGION 1..164: note = Description of Unknown:uncultivated organism with predicted taxonomy: Butyrivibriosp. CAG:318
  REGION 1..164: note = MG23-25 HNH domain
EHGKENDRKASRKKKLLDLYSALKRENKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQL

SEQ ID NO: 5414 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-26 HNH domain

SEQ ID NO: 5415 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-27 HNH domain

SEQ ID NO: 5416 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-28 HNH domain

SEQ ID NO: 5417 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-29 HNH domain

SEQ ID NO: 5418 - protein, 164 aa, unidentified; identical to SEQ ID NO: 5403
  REGION 1..164: note = Description of Unknown:uncultivated organism with predicted taxonomy: Butyrivibriosp. CAG:318
  REGION 1..164: note = MG23-30 HNH domain

SEQ ID NO: 5419 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-31 HNH domain

SEQ ID NO: 5420 - protein, 164 aa, unidentified
  REGION 1..164: note = Description of Unknown:uncultivated organism with predicted taxonomy: Butyrivibriosp. CAG:318
  REGION 1..164: note = MG23-32 HNH domain
EHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQL

SEQ ID NO: 5421 - protein, 165 aa, unidentified; identical to SEQ ID NO: 5406
  REGION 1..165: note = Description of Unknown:uncultivated organism with predicted taxonomy: Clostridiales
  REGION 1..165: note = MG23-33 HNH domain

SEQ ID NO: 5422 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-34 HNH domain

SEQ ID NO: 5423 - protein, 164 aa, unidentified
  REGION 1..164: note = Description of Unknown:uncultivated organism with predicted taxonomy: Butyrivibriosp. CAG:318
  REGION 1..164: note = MG23-35 HNH domain
EHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQL

SEQ ID NO: 5424 - protein, 165 aa, unidentified
  REGION 1..165: note = Description of Unknown:uncultivated organism with predicted taxonomy: Clostridiales
  REGION 1..165: note = MG23-36 HNH domain
EHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5425 - protein, 165 aa, unidentified; identical to SEQ ID NO: 5412
  REGION 1..165: note = Description of Unknown:uncultivated organism with predicted taxonomy: Clostridiales
  REGION 1..165: note = MG23-37 HNH domain

SEQ ID NO: 5426 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-38 HNH domain

SEQ ID NO: 5427 - protein, 164 aa, unidentified; identical to SEQ ID NO: 5403
  REGION 1..164: note = Description of Unknown:uncultivated organism with predicted taxonomy: Butyrivibriosp. CAG:318
  REGION 1..164: note = MG23-39 HNH domain

SEQ ID NO: 5428 - protein, 164 aa, unidentified
  REGION 1..164: note = Description of Unknown:uncultivated organism with predicted taxonomy: Butyrivibriosp. CAG:318
  REGION 1..164: note = MG23-40 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQL

SEQ ID NO: 5429 - protein, 165 aa, unidentified; identical to SEQ ID NO: 5406
  REGION 1..165: note = Description of Unknown:uncultivated organism with predicted taxonomy: Clostridiales
  REGION 1..165: note = MG23-41 HNH domain

SEQ ID NO: 5430 - protein, 164 aa, unidentified; identical to SEQ ID NO: 5420
  REGION 1..164: note = Description of Unknown:uncultivated organism with predicted taxonomy: Butyrivibriosp. CAG:318
  REGION 1..164: note = MG23-42 HNH domain

SEQ ID NO: 5431 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-43 HNH domain

SEQ ID NO: 5432 - protein, 164 aa, unidentified; identical to SEQ ID NO: 5400
  REGION 1..164: note = Description of Unknown:uncultivated organism with predicted taxonomy: Butyrivibriosp. CAG:318
  REGION 1..164: note = MG23-44 HNH domain

SEQ ID NO: 5433 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-45 HNH domain

SEQ ID NO: 5434 - protein, 165 aa, unidentified
  REGION 1..165: note = Description of Unknown:uncultivated organism with predicted taxonomy: Clostridiales
  REGION 1..165: note = MG23-46 HNH domain
EHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIKKDMSGFWKYLCEKKFITKEKYNRLMRTDKFSAEEKAAFVNRQL

SEQ ID NO: 5435 - protein, 164 aa, unidentified; identical to SEQ ID NO: 5428
  REGION 1..164: note = Description of Unknown:uncultivated organism with predicted taxonomy: Butyrivibriosp. CAG:318
  REGION 1..164: note = MG23-47 HNH domain

SEQ ID NO: 5436 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-48 HNH domain

SEQ ID NO: 5437 - protein, 165 aa, unidentified; identical to SEQ ID NO: 5412
  REGION 1..165: note = Description of Unknown:uncultivated organism with predicted taxonomy: Clostridiales
  REGION 1..165: note = MG23-49 HNH domain

SEQ ID NO: 5438 - protein, 164 aa, unidentified
  REGION 1..164: note = Description of Unknown:uncultivated organism with predicted taxonomy: Clostridiales
  REGION 1..164: note = MG23-50 HNH domain
EEGIKNERKNSRKKKLLELYTSIKNEQKAWSEVKIREIDGRTETDFRIKKLYLYYLQHGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQL

SEQ ID NO: 5439 - protein, 165 aa, unidentified
  REGION 1..165: note = Description of Unknown:uncultivated organism with predicted taxonomy: Clostridiales
  REGION 1..165: note = MG23-51 HNH domain
EHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5440 - protein, 164 aa, unidentified; identical to SEQ ID NO: 5420
  REGION 1..164: note = Description of Unknown:uncultivated organism with predicted taxonomy: Butyrivibriosp. CAG:318
  REGION 1..164: note = MG23-52 HNH domain

SEQ ID NO: 5441 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-53 HNH domain

SEQ ID NO: 5442 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-54 HNH domain

SEQ ID NO: 5443 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-55 HNH domain

SEQ ID NO: 5444 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-56 HNH domain

SEQ ID NO: 5445 - protein, 164 aa, unidentified; identical to SEQ ID NO: 5399
  REGION 1..164: note = Description of Unknown:uncultivated organism with predicted taxonomy: Butyrivibriosp. CAG:318
  REGION 1..164: note = MG23-57 HNH domain

SEQ ID NO: 5446 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-58 HNH domain

SEQ ID NO: 5447 - protein, 165 aa, unidentified; identical to SEQ ID NO: 5406
  REGION 1..165: note = Description of Unknown:uncultivated organism with predicted taxonomy: Clostridiales
  REGION 1..165: note = MG23-59 HNH domain

SEQ ID NO: 5448 - protein, 165 aa, unidentified
  REGION 1..165: note = Description of Unknown:uncultivated organism with predicted taxonomy: Clostridiales
  REGION 1..165: note = MG23-60 HNH domain
EHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKATFVNRQL

SEQ ID NO: 5449 - protein, 93 aa, unidentified
  REGION 1..93: note = Description of Unknown:uncultivated organism with predicted taxonomy: Clostridiales
  REGION 1..93: note = MG23-61 HNH domain
EHENGNERKASRKKKLLDLYKAIKSEQKQWAEQMIAEIDKRDEADFRIKKLYLYYIQQGKCMYSGDTIDLDLLLKNNNIYDIDHIYPRHFIKD

SEQ ID NO: 5450 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-62 HNH domain

SEQ ID NO: 5451 - protein, 164 aa, unidentified
  REGION 1..164: note = Description of Unknown:uncultivated organism with predicted taxonomy: Butyrivibriosp. CAG:318
  REGION 1..164: note = MG23-63 HNH domain
EHGKENDRKASRKKKLLDLYSTLKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQL

SEQ ID NO: 5452 - protein, 165 aa, unidentified; identical to SEQ ID NO: 5434
  REGION 1..165: note = Description of Unknown:uncultivated organism with predicted taxonomy: Clostridiales
  REGION 1..165: note = MG23-64 HNH domain

SEQ ID NO: 5453 - protein, 165 aa, unidentified; identical to SEQ ID NO: 5398
  REGION 1..165: note = Description of Unknown:uncultivated organism with predicted taxonomy: Clostridiales
  REGION 1..165: note = MG23-65 HNH domain

SEQ ID NO: 5454 - protein, 164 aa, unidentified; identical to SEQ ID NO: 5423
  REGION 1..164: note = Description of Unknown:uncultivated organism with predicted taxonomy: Butyrivibriosp. CAG:318
  REGION 1..164: note = MG23-66 HNH domain

SEQ ID NO: 5455 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-67 HNH domain

SEQ ID NO: 5456 - protein, 164 aa, unidentified; identical to SEQ ID NO: 5423
  REGION 1..164: note = Description of Unknown:uncultivated organism with predicted taxonomy: Butyrivibriosp. CAG:318
  REGION 1..164: note = MG23-68 HNH domain

SEQ ID NO: 5457 - protein, 164 aa, unidentified
  REGION 1..164: note = Description of Unknown:uncultivated organism with predicted taxonomy: Butyrivibriosp. CAG:318
  REGION 1..164: note = MG23-69 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQL

SEQ ID NO: 5458 - protein, 164 aa, unidentified; identical to SEQ ID NO: 5405
  REGION 1..164: note = Description of Unknown:uncultivated organism with predicted taxonomy: Butyrivibriosp. CAG:318
  REGION 1..164: note = MG23-70 HNH domain

SEQ ID NO: 5459 - protein, 140 aa, unidentified
  REGION 1..140: note = Description of Unknown:uncultivated organism with predicted taxonomy: Butyrivibriosp. YAB3001
  REGION 1..140: note = MG23-71 HNH domain
EEGEKGKRTESRKKKLEFLYKGQKQFLQEIGKRDERDFRQKKLYLYYLQNGKSMYTGNEIDLDELLSNNSKYDIDHIYPRHYIKDDSLDNNLVLVEKEINNDIKGGDYPISKTIQSKMRSFWKELQEKGFITSEKYNRLV

SEQ ID NO: 5460 - protein, 164 aa, unidentified
  REGION 1..164: note = Description of Unknown:uncultivated organism with predicted taxonomy: Eubacterium
  REGION 1..164: note = MG23-72 HNH domain
EEGIKNERKNSRKKKLLELYTSIKNEQKAWSEVKIREIDGRTETDFRIKKLYLYYLQQGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQL

SEQ ID NO: 5461 - RNA, 121 nt, synthetic construct
  misc_feature 1..121: note = Description of Artificial Sequence: Syntheticpolynucleotide
  misc_feature 1..121: note = MG1-4 sgRNA
  source 1..121: mol_type = other RNA
nnnnnnnnnnnnnnnnnnnnnngttttgatttactcgaaagagtccaatcataattgaccggagaataattgattcctctacaatgtacgaataaattcattctctaaaccttaaaaattt

SEQ ID NO: 5462 - RNA, 99 nt, synthetic construct
  misc_feature 1..99: note = Description of Artificial Sequence: Syntheticoligonucleotide
  misc_feature 1..99: note = MG1-5 sgRNA
  source 1..99: mol_type = other RNA
nnnnnnnnnnnnnnnnnnnnnngttttgacttgaaaaagtcttaactgattttgccgaattttaagctctacgtagtaccttggaattcggcatatttt

SEQ ID NO: 5463 - RNA, 99 nt, synthetic construct
  misc_feature 1..99: note = Description of Artificial Sequence: Syntheticoligonucleotide
  misc_feature 1..99: note = MG1-6 sgRNA
  source 1..99: mol_type = other RNA
nnnnnnnnnnnnnnnnnnnnnngttttgacttgaaaaagtcttaactgattttgccgaatttcaagctctgcattgcaccttggcattcggcatatttt

SEQ ID NO: 5464 - RNA, 99 nt, synthetic construct
  misc_feature 1..99: note = Description of Artificial Sequence: Syntheticoligonucleotide
  misc_feature 1..99: note = MG1-7 sgRNA
  source 1..99: mol_type = other RNA
nnnnnnnnnnnnnnnnnnnnnngttttgactttgaaaaaagtcttaactgattttgccgaattttaagctctgcatggcaccttgaaattcggcatttt

SEQ ID NO: 5465 - RNA, 100 nt, synthetic construct
  misc_feature 1..100: note = Description of Artificial Sequence: Syntheticpolynucleotide
  misc_feature 1..100: note = MG2-7 sgRNA
  source 1..100: mol_type = other RNA
nnnnnnnnnnnnnnnnnnnnnngctttgccttggaaacaagacaaagttaattaaggcagttcggacctctactttgtacgtcaggatagaaagcctttt

SEQ ID NO: 5466 - RNA, 110 nt, synthetic construct
  misc_feature 1..110: note = Description of Artificial Sequence: Syntheticpolynucleotide
  misc_feature 1..110: note = MG3-6 sgRNA
  source 1..110: mol_type = other RNA
nnnnnnnnnnnnnnnnnnnnnngttgagaatcgaaagattcttaataaggcatccttccgatgctgacttctcaccgtccgttttccaataggagcgggcggtatgtttt

SEQ ID NO: 5467 - RNA, 110 nt, synthetic construct
  misc_feature 1..110: note = Description of Artificial Sequence: Syntheticpolynucleotide
  misc_feature 1..110: note = MG3-7 sgRNA
  source 1..110: mol_type = other RNA
nnnnnnnnnnnnnnnnnnnnnngttgggaaccgaaaggttcccaataaggcgcatcttggcgctgacttctcaccgtcctcttgctgcttagcagagggcggtatgtttt

SEQ ID NO: 5468 - RNA, 124 nt, synthetic construct
  misc_feature 1..124: note = Description of Artificial Sequence: Syntheticpolynucleotide
  misc_feature 1..124: note = MG4-5 sgRNA
  source 1..124: mol_type = other RNA
nnnnnnnnnnnnnnnnnnnnnngctgtggcttgcgggggaaaccccttgtcacagtaagggactttcgttcgcgaaaggcaacctcgccagcatcgctgggcgaggaccagggcaaggcgattt

SEQ ID NO: 5469 - RNA, 118 nt, synthetic construct
  misc_feature 1..118: note = Description of Artificial Sequence: Syntheticpolynucleotide
  misc_feature 1..118: note = MG14-1 sgRNA
  source 1..118: mol_type = other RNA
nnnnnnnnnnnnnnnnnnnnnngtcttgagcgaaagctccagacaaggggagccacttaagtggcttacccgtaaagtaacccccgttcaatcttcggattgggcggggcgaactttt

SEQ ID NO: 5470 - RNA, 118 nt, synthetic construct
  misc_feature 1..118: note = Description of Artificial Sequence: Syntheticpolynucleotide
  misc_feature 1..118: note = MG15-1 sgRNA
  source 1..118: mol_type = other RNA
nnnnnnnnnnnnnnnnnnnnnngttgtaattccctagaaataggttattacaataaggtccaacaggagtgttggtaccgtaaagctctaacggcacccacgggtgccgttatctttt

SEQ ID NO: 5471 - RNA, 162 nt, synthetic construct
  misc_feature 1..162: note = Description of Artificial Sequence: Syntheticpolynucleotide
  misc_feature 1..162: note = MG16-2 sgRNA
  source 1..162: mol_type = other RNA
nnnnnnnnnnnnnnnnnnnnnngttgtgaattgctttaaattgaaaaatttaagcaattcacaataaggattattccgttgtgaaaacatttaaagcggggtcaacagcctcgctttctttttgagtctatgagacattaggtcaataagtctatgagtttt

SEQ ID NO: 5472 - RNA, 101 nt, synthetic construct
  misc_feature 1..101: note = Description of Artificial Sequence: Syntheticpolynucleotide
  misc_feature 1..101: note = MG18-1 sgRNA
  source 1..101: mol_type = other RNA
nnnnnnnnnnnnnnnnnnnnnngtttgagagtagtgaaaactacgagttcaaatacaattttttcaaattgccctatagggccctcacagtgtgagatttt

SEQ ID NO: 5473 - RNA, 117 nt, synthetic construct
  misc_feature 1..117: note = Description of Artificial Sequence: Syntheticpolynucleotide
  misc_feature 1..117: note = MG21-1 sgRNA
  source 1..117: mol_type = other RNA
nnnnnnnnnnnnnnnnnnnnnngttgtagttccccttttgaaaaaaagtgtgttactgcaataaggtaaaacaccacgaagctctgccctaactgccttagcagttagggcatcttt

SEQ ID NO: 5474 - RNA, 134 nt, synthetic construct
  misc_feature 1..134: note = Description of Artificial Sequence: Syntheticpolynucleotide
  misc_feature 1..134: note = MG22-1 sgRNA
  source 1..134: mol_type = other RNA
nnnnnnnnnnnnnnnnnnnnnngttgtgaattgctttcaaattagaaataattgaaagcaattcgcaataaggattattccgttgtgaaaacatttcgagtggcttcgtgaaattcacgaagtcacttcgtttt

SEQ ID NO: 5475 - RNA, 113 nt, synthetic construct
  misc_feature 1..113: note = Description of Artificial Sequence: Syntheticpolynucleotide
  misc_feature 1..113: note = MG23-1 sgRNA
  source 1..113: mol_type = other RNA
nnnnnnnnnnnnnnnnnnnnnngtttgagaacctgaaaaggtgagtgcaaataaggtttaaccgaaattgtttacctgcattgtgcagtataagaaagaccgcgaggtctttt

SEQ ID NO: 5476 - RNA, 99 nt, unidentified
  misc_feature 1..99: note = Description of Unknown:uncultivated organism with predicted taxonomy: CandidatusMelainabacteria
  misc_feature 1..99: note = MG1-4 tracrRNA
  source 1..99: mol_type = unassigned RNA
taaaatattttaagttaagagtccaatcataattgaccggagaataattgattcctctacaatgtacgaataaattcattctctaaaccttaaaaattt

SEQ ID NO: 5477 - RNA, 72 nt, unidentified
  misc_feature 1..72: note = Description of Unknown:uncultivated organism with predicted taxonomy: Verrucomicrobia
  misc_feature 1..72: note = MG1-5 tracrRNA
  source 1..72: mol_type = unassigned RNA
ttagttgtaaagtcttaactgattttgccgaattttaagctctacgtagtaccttggaattcggcatatttt

SEQ ID NO: 5478 - RNA, 72 nt, unidentified
  misc_feature 1..72: note = Description of Unknown:uncultivated organism with predicted taxonomy: unclassifiedVerrucomicrobia (miscellaneous)
  misc_feature 1..72: note = MG1-6 tracrRNA
  source 1..72: mol_type = unassigned RNA
tttgttgtaaagtcttaactgattttgccgaatttcaagctctgcattgcaccttggcattcggcatatttt

SEQ ID NO: 5479 - RNA, 78 nt, unidentified
  misc_feature 1..78: note = Description of Unknown:uncultivated organism with predicted taxonomy: unclassifiedVerrucomicrobia (miscellaneous)
  misc_feature 1..78: note = MG1-7 tracrRNA
  source 1..78: mol_type = unassigned RNA
agaaaatttttgttgtaaagtcttaactgattttgccgaattttaagctctgcatggcaccttgaaattcggcatttt

SEQ ID NO: 5480 - RNA, 106 nt, unidentified
  misc_feature 1..106: note = Description of Unknown:uncultivated organism
  misc_feature 1..106: note = MG1-1
  source 1..106: mol_type = unassigned RNA
ctctccggggggagaagtcttaactgattcggcggcgttgaaaccactgcctagcacgtttcaacgccgccctttattcccaaaactcgacctgctgttgaatttt

SEQ ID NO: 5481 - RNA, 77 nt, unidentified
  misc_feature 1..77: note = Description of Unknown:uncultivated organism with predicted taxonomy: Verrucomicrobia
  misc_feature 1..77: note = MG1-2
  source 1..77: mol_type = unassigned RNA
gacttttctggggagtgaagtcttaactgatttagccccgcagtgaccactgcttgcacgtcactgcggggcctttt

SEQ ID NO: 5482 - RNA, 383 nt, unidentified
  misc_feature 1..383: note = Description of Unknown:uncultivated organism
  misc_feature 1..383: note = MG1-3
  source 1..383: mol_type = unassigned RNA
gataccggagaattttgggcttccctgatagccatttcaaaaagggtttgataggattgtnntataaggtttgtagagcatgttgggaatgtatcttcaaaagaatttgnnggcgtataaaagaaaaactcagaaacacattgttctgagtttttttctgtcccgaccgttgattgnntaaaggtcctttttcttacagacaaacaatgggaaaagtcagtcaattgcatcggaaaagnnaatatgagcacagcaaaaaactcctcgacccagcacagccggaactctttgaaatttggtnnaaaggaaagccacgactggtgcttttctggaaagcagtgcagccgtttctttcctattcgnnttaagatttacccgactcg

SEQ ID NO: 5483 - RNA, 383 nt, unidentified; identical to SEQ ID NO: 5482
  misc_feature 1..383: note = Description of Unknown:uncultivated organism
  misc_feature 1..383: note = MG1-3
  source 1..383: mol_type = unassigned RNA

SEQ ID NO: 5484 - RNA, 70 nt, unidentified
  misc_feature 1..70: note = Description of Unknown:uncultivated organism
  misc_feature 1..70: note = MG1-8
  source 1..70: mol_type = unassigned RNA
ggggggaaggcttaactgacgtagaggcccgtgacccactgcatcgcacggtcacgggcctcggtgtttt

SEQ ID NO: 5485 - RNA, 70 nt, unidentified; identical to SEQ ID NO: 5484
  misc_feature 1..70: note = Description of Unknown:uncultivated organism with predicted taxonomy: Verrucomicrobia
  misc_feature 1..70: note = MG1-9
  source 1..70: mol_type = unassigned RNA

SEQ ID NO: 5486 - RNA, 100 nt, unidentified
  misc_feature 1..100: note = Description of Unknown:uncultivated organism
  misc_feature 1..100: note = MG1-10
  source 1..100: mol_type = unassigned RNA
acttcaaaaccagcaccccaagtagcgtaggagagcgcgttcgatcttggattcaggtgtgactccactacgaaagccccttgatttctcaagggtcttt

SEQ ID NO: 5487 - RNA, 69 nt, unidentified
  misc_feature 1..69: note = Description of Unknown:uncultivated organism
  misc_feature 1..69: note = MG1-11
  source 1..69: mol_type = unassigned RNA
ggcgatttcaaaaccagcacggattcggcagcccctctgcggggcaagcgtaggtagagcgcgccgttt

SEQ ID NO: 5488 - RNA, 108 nt, unidentified
  misc_feature 1..108: note = Description of Unknown:uncultivated organism
  misc_feature 1..108: note = MG1-12
  source 1..108: mol_type = unassigned RNA
cgagatcaaaacctgcggtggccagtattccaaactgtcggcttgagagcaggctggttattaaccgcaactcttgcacgggggcgagtgaaagctttagcccctttt

SEQ ID NO: 5489 - RNA, 106 nt, unidentified; identical to SEQ ID NO: 5480
  misc_feature 1..106: note = Description of Unknown:uncultivated organism
  misc_feature 1..106: note = MG1-14
  source 1..106: mol_type = unassigned RNA

SEQ ID NO: 5490 - RNA, 101 nt, unidentified
  misc_feature 1..101: note = Description of Unknown:uncultivated organism
  misc_feature 1..101: note = MG2-1 tracrRNA
  source 1..101: mol_type = unassigned RNA
gccagatcaaaacctgcggaatggtcggttcgagagccacccataagaacccgcaactcgaacacactttccggggcgagccagatgctcgccccgctttt

SEQ ID NO: 5491 - RNA, 70 nt, unidentified
  misc_feature 1..70: note = Description of Unknown:uncultivated organism
  misc_feature 1..70: note = MG2-7 tracrRNA
  source 1..70: mol_type = unassigned RNA
ttggaatcaagacaaagttaattaaggcagttcggacctctactttgtacgtcaggatagaaagcctttt

SEQ ID NO: 5492 - RNA, 118 nt, unidentified
  misc_feature 1..118: note = Description of Unknown:uncultivated organism with predicted taxonomy: Verrucomicrobia
  misc_feature 1..118: note = MG2-5
  source 1..118: mol_type = unassigned RNA
ttggaatcaagacaaagttagataacgcaaactgcgtccctatccgccaagcggatacacctgttcaaaagcgtttcttaaagagcctcggcagggagtaatctcggtcggggctttt

SEQ ID NO: 5493 - RNA, 74 nt, unidentified
  misc_feature 1..74: note = Description of Unknown:uncultivated organism with predicted taxonomy: Verrucomicrobia
  misc_feature 1..74: note = MG2-8
  source 1..74: mol_type = unassigned RNA
ggaatcaagacaaagttagataacgcagaccgtttccctatccgccacgcggatacatcggttcaaaagcgttt

SEQ ID NO: 5494 - RNA, 74 nt, unidentified; identical to SEQ ID NO: 5493
  misc_feature 1..74: note = Description of Unknown:uncultivated organism with predicted taxonomy: Verrucomicrobia
  misc_feature 1..74: note = MG2-10
  source 1..74: mol_type = unassigned RNA

SEQ ID NO: 5495 - RNA, 82 nt, unidentified
  misc_feature 1..82: note = Description of Unknown:uncultivated organism with predicted taxonomy: Rothia
  misc_feature 1..82: note = MG3-6 tracrRNA
  source 1..82: mol_type = unassigned RNA
taacgaaagattcttaataaggcatccttccgatgctgacttctcaccgtccgttttccaataggagcgggcggtatgtttt

SEQ ID NO: 5496 - RNA, 80 nt, unidentified
  misc_feature 1..80: note = Description of Unknown:uncultivated organism with predicted taxonomy: Rothia
  misc_feature 1..80: note = MG3-7 tracrRNA
  source 1..80: mol_type = unassigned RNA
aatgaaggttcccaataaggcgcatcttggcgctgacttctcaccgtcctcttgctgcttagcagagggcggtatgtttt

SEQ ID NO: 5497 - RNA, 82 nt, unidentified
  misc_feature 1..82: note = Description of Unknown:uncultivated organism with predicted taxonomy: Rothia
  misc_feature 1..82: note = MG3-8 tracrRNA
  source 1..82: mol_type = unassigned RNA
taacgaaagattcttaataaggcatccttccgatgctgacttctcaccgtccggctcctcttaggaacgggcggtatgtttt

SEQ ID NO: 5498 - RNA, 78 nt, unidentified
  misc_feature 1..78: note = Description of Unknown:uncultivated organism with predicted taxonomy: Dermabacterhominis
  misc_feature 1..78: note = MG3-1
  source 1..78: mol_type = unassigned RNA
tcttgggagagacattgaaataagcggtttcgtaccgtgaattctccagcccctcggtttaccggggggcttcgtttt

SEQ ID NO: 5499 - RNA, 88 nt, unidentified
  misc_feature 1..88: note = Description of Unknown:uncultivated organism with predicted taxonomy: Micrococcales
  misc_feature 1..88: note = MG3-5
  source 1..88: mol_type = unassigned RNA
tggtttcggaggcgaacgatcccaataagagacttatgtcttgaattctcagatcccgtccgcattgcgcggacgggatcttcgtttt

SEQ ID NO: 5500 - RNA, 81 nt, unidentified
  misc_feature 1..81: note = Description of Unknown:uncultivated organism with predicted taxonomy: Rothia
  misc_feature 1..81: note = MG3-6
  source 1..81: mol_type = unassigned RNA
agagaagattcccaataaggcacatttttagtgctgacttctcaccgtccagggttcattgaacaatgggcggtatgtttt

SEQ ID NO: 5501 - RNA, 72 nt, unidentified
  misc_feature 1..72: note = Description of Unknown:uncultivated organism with predicted taxonomy: Rothia
  misc_feature 1..72: note = MG3-7
  source 1..72: mol_type = unassigned RNA
tgaaagattctcaacattctacaacttatcacatagcacattgcaattatagcaggagtatatgtagctttt

SEQ ID NO: 5502 - RNA, 82 nt, unidentified; identical to SEQ ID NO: 5497
  misc_feature 1..82: note = Description of Unknown:uncultivated organism with predicted taxonomy: Rothia
  misc_feature 1..82: note = MG3-8
  source 1..82: mol_type = unassigned RNA

SEQ ID NO: 5503 - RNA, 103 nt, unidentified
  misc_feature 1..103: note = Description of Unknown:uncultivated organism with predicted taxonomy: Planctomycetes
  misc_feature 1..103: note = MG4-5 tracrRNA
  source 1..103: mol_type = unassigned RNA
agtgtatccgagcggcgattgccccttgtcacagtaagggactttcgttcgcgaaaggcaacctcgccagcatcgctgggcgaggaccagggcaaggcgattt

SEQ ID NO: 5504 - RNA, 98 nt, unidentified
  misc_feature 1..98: note = Description of Unknown:uncultivated organism with predicted taxonomy: Arcicellaaurantiaca
  misc_feature 1..98: note = MG7-2
  source 1..98: mol_type = unassigned RNA
ttcaactttacgtaagaacaatttgtaagcaattcacaataaaaggtttttaccgttgtgaaaacatattctggcggtaactttagttatcgcctttt

SEQ ID NO: 5505 - RNA, 103 nt, unidentified
  misc_feature 1..103: note = Description of Unknown:uncultivated organism with predicted taxonomy: Collinsella
  misc_feature 1..103: note = MG14-1 tracrRNA
  source 1..103: mol_type = unassigned RNA
tcaccttggggaagggcgcggctccagacaaggggagccacttaagtggcttacccgtaaagtaacccccgttcaatcttcggattgggcggggcgaactttt

SEQ ID NO: 5506 - RNA, 100 nt, unidentified
  misc_feature 1..100: note = Description of Unknown:uncultivated organism with predicted taxonomy: Megasphaera
  misc_feature 1..100: note = MG15-1 tracrRNA
  source 1..100: mol_type = unassigned RNA
attatatcttagcgagagatagtaggttattacaataaggtccaacaggagtgttggtaccgtaaagctctaacggcacccacgggtgccgttatctttt

SEQ ID NO: 5507 - RNA, 87 nt, unidentified
  misc_feature 1..87: note = Description of Unknown:uncultivated organism with predicted taxonomy: Bacteroidales
  misc_feature 1..87: note = MG16-2 tracrRNA
  source 1..87: mol_type = unassigned RNA
ttgtgaattgcttaaattatgtactgcaaaaataaacaaatattattacgaaaaagtttttttaaaaatatttttttacataacttt

SEQ ID NO: 5508 - RNA, 83 nt, unidentified
  misc_feature 1..83: note = Description of Unknown:uncultivated organism with predicted taxonomy: Clostridiales
  misc_feature 1..83: note = MG18-1 tracrRNA
  source 1..83: mol_type = unassigned RNA
ttgactaccataaggaattacactacgagttcaaatacaattttttcaaattgccctatagggccctcacagtgtgagatttt

SEQ ID NO: 5509 - RNA, 92 nt, unidentified
  misc_feature 1..92: note = Description of Unknown:uncultivated organism with predicted taxonomy: Firmicutes
  misc_feature 1..92: note = MG21-1 tracrRNA
  source 1..92: mol_type = unassigned RNA
ttataccactacgagagaaaaagtgtgttactgcaataaggtaaaacaccacgaagctctgccctaactgccttagcagttagggcatcttt

SEQ ID NO: 5510 - RNA, 90 nt, unidentified
  misc_feature 1..90: note = Description of Unknown:uncultivated organism with predicted taxonomy: Bacteroidales
  misc_feature 1..90: note = MG22-1 tracrRNA
  source 1..90: mol_type = unassigned RNA
ttgctaattgaaagcaattcgcaataaggattattccgttgtgaaaacatttcgagtggcttcgtgaaattcacgaagtcacttcgtttt

SEQ ID NO: 5511 - RNA, 82 nt, unidentified
  misc_feature 1..82: note = Description of Unknown:uncultivated organism with predicted taxonomy: Clostridia
  misc_feature 1..82: note = MG23-1 tracrRNA
  source 1..82: mol_type = unassigned RNA
acttacaaggtgagtgcaaataaggtttaaccgaaattgtttacctgcattgtgcagtataagaaagaccgcgaggtctttt

SEQ ID NO: 5512-5537 - skipped (26 entries)

SEQ ID NO: 5538 - RNA, 72 nt, unidentified
  misc_feature 1..72: note = Description of Unknown:uncultivated organism
  misc_feature 1..72: note = MG2-4 putative tracrRNA
  source 1..72: mol_type = unassigned RNA
tttgaatcaagatcaaagtaaacggccccgctccggaccctgcctggcactccggatgcgctagggtttttt

SEQ ID NO: 5539 - RNA, 110 nt, synthetic construct
  misc_feature 1..110: note = Description of Artificial Sequence: Syntheticpolynucleotide
  misc_feature 1..110: note = MG3-8 putative sgRNA
  source 1..110: mol_type = other RNA
nnnnnnnnnnnnnnnnnnnnnngttgagaatcgaaagattcttaataaggcatccttccgatgctgacttctcaccgtccggctcctcttaggaacgggcggtatgtttt

SEQ ID NO: 5540 - RNA, 143 nt, synthetic construct
  misc_feature 1..143: note = Description of Artificial Sequence: Syntheticpolynucleotide
  misc_feature 1..143: note = MG16-2 putative sgRNA
  source 1..143: mol_type = other RNA
nnnnnnnnnnnnnnnnnnnnnngttgtgaattgaaaaattcacaataaggattattccgttgtgaaaacatttaaagcggggtcaacagcctcgctttctttttgagtctatgagacattaggtcaataagtctatgagtttt

SEQ ID NO: 5541 - DNA, 122 bp, synthetic construct
  misc_feature 1..122: note = Description of Artificial Sequence: Syntheticpolynucleotide
  misc_feature 1..122: note = MG16-2 putative sgRNA
  source 1..122: mol_type = other DNA
nnnnnnnnnnnnnnnnnnnnnngttgtgaattgctttaaattgaaaaatttaagcaattcacaataaggattattccgttgtgaaaacatttaaagcggggtcaacagcctcgctttctttt

SEQ ID NO: 5542 - DNA, 103 bp, synthetic construct
  misc_feature 1..103: note = Description of Artificial Sequence: Syntheticpolynucleotide
  misc_feature 1..103: note = MG16-2 putative sgRNA
  source 1..103: mol_type = other DNA
nnnnnnnnnnnnnnnnnnnnnngttgtgaattgaaaaattcacaataaggattattccgttgtgaaaacatttaaagcggggtcaacagcctcgctttctttt

SEQ ID NO: 5543 - RNA, 22 nt, synthetic construct
  misc_feature 1..22: note = Description of Artificial Sequence: Syntheticoligonucleotide
  misc_feature 1..22: note = MG1-4 guide sequence 1 for targeting VEGFA
  source 1..22: mol_type = other RNA
aatatgtagctgtttgggaggt

SEQ ID NO: 5544 - RNA, 22 nt, synthetic construct
  misc_feature 1..22: note = Description of Artificial Sequence: Syntheticoligonucleotide
  misc_feature 1..22: note = MG1-4 guide sequence 2 for targeting VEGFA
  source 1..22: mol_type = other RNA
ctagggggcgctcggccaccac

SEQ ID NO: 5545 - RNA, 22 nt, synthetic construct
  misc_feature 1..22: note = Description of Artificial Sequence: Syntheticoligonucleotide
  misc_feature 1..22: note = MG1-4 guide sequence 3 for targeting VEGFA
  source 1..22: mol_type = other RNA
tggctaaagagggaatgggctt

SEQ ID NO: 5546 - RNA, 22 nt, synthetic construct
  misc_feature 1..22: note = Description of Artificial Sequence: Syntheticoligonucleotide
  misc_feature 1..22: note = MG1-4 guide sequence 4 for targeting VEGFA
  source 1..22: mol_type = other RNA
cacaccccggctctggctaaag

SEQ ID NO: 5547 - RNA, 22 nt, synthetic construct
  misc_feature 1..22: note = Description of Artificial Sequence: Syntheticoligonucleotide
  misc_feature 1..22: note = MG1-4 guide sequence 5 for targeting VEGFA
  source 1..22: mol_type = other RNA
tcggaggagccgtggtccgcgc

SEQ ID NO: 5548 - RNA, 22 nt, synthetic construct
  misc_feature 1..22: note = Description of Artificial Sequence: Syntheticoligonucleotide
  misc_feature 1..22: note = MG1-4 guide sequence 6 for targeting VEGFA
  source 1..22: mol_type = other RNA
gcggaccacggctcctccgaag

SEQ ID NO: 5549 - RNA, 22 nt, synthetic construct
  misc_feature 1..22: note = Description of Artificial Sequence: Syntheticoligonucleotide
  misc_feature 1..22: note = MG1-4 guide sequence 7 for targeting EMX1
  source 1..22: mol_type = other RNA
gtacaaacggcagaagctggag

SEQ ID NO: 5550 - RNA, 23 nt, synthetic construct
  misc_feature 1..23: note = Description of Artificial Sequence: Syntheticoligonucleotide
  misc_feature 1..23: note = MG1-4 guide sequence 8 for targeting EMX1
  source 1..23: mol_type = other RNA
gaggaagggcctgagtccgagca

SEQ ID NO: 5551 - RNA, 22 nt, synthetic construct
  misc_feature 1..22: note = Description of Artificial Sequence: Syntheticoligonucleotide
  misc_feature 1..22: note = MG1-4 guide sequence 9 for targeting Apolipoprotein
  source 1..22: mol_type = other RNA
aaggcaaacatcctgataatgg

SEQ ID NO: 5552 - RNA, 22 nt, synthetic construct
  misc_feature 1..22: note = Description of Artificial Sequence: Syntheticoligonucleotide
  misc_feature 1..22: note = MG1-6 guide sequence 1 for targeting VEGFA
  source 1..22: mol_type = other RNA
tctttagccagagccggggtgt

SEQ ID NO: 5553 - RNA, 22 nt, synthetic construct
  misc_feature 1..22: note = Description of Artificial Sequence: Syntheticoligonucleotide
  misc_feature 1..22: note = MG1-6 guide sequence 2 for targeting VEGFA
  source 1..22: mol_type = other RNA
tggaccccctatttctgacctc

SEQ ID NO: 5554 - RNA, 22 nt, synthetic construct
  misc_feature 1..22: note = Description of Artificial Sequence: Syntheticoligonucleotide
  misc_feature 1..22: note = MG1-6 guide sequence 3 for targeting EMX1
  source 1..22: mol_type = other RNA
atgggagcccttcttcttctgc

SEQ ID NO: 5555 - RNA, 22 nt, synthetic construct
  misc_feature 1..22: note = Description of Artificial Sequence: Syntheticoligonucleotide
  misc_feature 1..22: note = MG1-6 guide sequence 4 for targeting EMX1
  source 1..22: mol_type = other RNA
tgccacgaagcaggccaatggg

SEQ ID NO: 5556 - RNA, 22 nt, synthetic construct
  misc_feature 1..22: note = Description of Artificial Sequence: Syntheticoligonucleotide
  misc_feature 1..22: note = MG1-6 guide sequence 5 for targeting HBB-R01
  source 1..22: mol_type = other RNA
tggtgtctgtttgaggttgcta

SEQ ID NO: 5557 - RNA, 22 nt, synthetic construct
  misc_feature 1..22: note = Description of Artificial Sequence: Syntheticoligonucleotide
  misc_feature 1..22: note = MG1-6 guide sequence 6 for targeting HBB-R01
  source 1..22: mol_type = other RNA
gggcaggttggtatcaaggtta

SEQ ID NO: 5558 - RNA, 22 nt, synthetic construct
  misc_feature 1..22: note = Description of Artificial Sequence: Syntheticoligonucleotide
  misc_feature 1..22: note = MG1-6 guide sequence 7 for targeting FANCF
  source 1..22: mol_type = other RNA
aggtgctgacgtaggtagtgct

SEQ ID NO: 5559 - RNA, 22 nt, synthetic construct
  misc_feature 1..22: note = Description of Artificial Sequence: Syntheticoligonucleotide
  misc_feature 1..22: note = MG1-6 guide sequence 8 for targeting FANCF
  source 1..22: mol_type = other RNA
gccctacttccgctttcacctt

SEQ ID NO: 5560 - RNA, 22 nt, synthetic construct
  misc_feature 1..22: note = Description of Artificial Sequence: Syntheticoligonucleotide
  misc_feature 1..22: note = MG1-6 guide sequence 9 for targeting IVS40
  source 1..22: mol_type = other RNA
aatgtatgctggcttttaaggg

SEQ ID NO: 5561 - RNA, 22 nt, synthetic construct
  misc_feature 1..22: note = Description of Artificial Sequence: Syntheticoligonucleotide
  misc_feature 1..22: note = MG1-6 guide sequence 10 for targeting IVS40
  source 1..22: mol_type = other RNA
gctcctttggctagggaagtgt

SEQ ID NO: 5562 - RNA, 22 nt, synthetic construct
  misc_feature 1..22: note = Description of Artificial Sequence: Syntheticoligonucleotide
  misc_feature 1..22: note = MG3-7 guide sequence 1 for targeting VEGFA
  source 1..22: mol_type = other RNA
cccctatttctgacctcccaaa

SEQ ID NO: 5563 - RNA, 22 nt, synthetic construct
  misc_feature 1..22: note = Description of Artificial Sequence: Syntheticoligonucleotide
  misc_feature 1..22: note = MG3-7 guide sequence 2 for targeting EMX1
  source 1..22: mol_type = other RNA
tgtggttccagaaccggaggac

SEQ ID NO: 5564 - RNA, 22 nt, synthetic construct
  misc_feature 1..22: note = Description of Artificial Sequence: Syntheticoligonucleotide
  misc_feature 1..22: note = MG3-7 guide sequence 3 for targeting HBB-R01
  source 1..22: mol_type = other RNA
ggccctgggcaggttggtatca

SEQ ID NO: 5565 - RNA, 22 nt, synthetic construct
  misc_feature 1..22: note = Description of Artificial Sequence: Syntheticoligonucleotide
  misc_feature 1..22: note = MG3-7 guide sequence 4 for targeting HBB-R01
  source 1..22: mol_type = other RNA
tccttaaacctgtcttgtaacc

SEQ ID NO: 5566 - RNA, 22 nt, synthetic construct
  misc_feature 1..22: note = Description of Artificial Sequence: Syntheticoligonucleotide
  misc_feature 1..22: note = MG3-7 guide sequence 5 for targeting HBB-R01
  source 1..22: mol_type = other RNA
ctgactcctgaggagaagtctg

SEQ ID NO: 5567 - RNA, 22 nt, synthetic construct
  misc_feature 1..22: note = Description of Artificial Sequence: Syntheticoligonucleotide
  misc_feature 1..22: note = MG3-7 guide sequence 6 for targeting FANCF
  source 1..22: mol_type = other RNA
tccgagcttctggcggtctcaa

SEQ ID NO: 5568 - RNA, 22 nt, synthetic construct
  misc_feature 1..22: note = Description of Artificial Sequence: Syntheticoligonucleotide
  misc_feature 1..22: note = MG3-7 guide sequence 7 for targeting FANCF
  source 1..22: mol_type = other RNA
tatcatttcgcggatgttccaa

SEQ ID NO: 5569 - RNA, 22 nt, synthetic construct
  misc_feature 1..22: note = Description of Artificial Sequence: Syntheticoligonucleotide
  misc_feature 1..22: note = MG3-7 guide sequence 8 for targeting Apolipoprotein
  source 1..22: mol_type = other RNA
tcgggcagagggtgcatcacct

SEQ ID NO: 5570 - RNA, 22 nt, synthetic construct
  misc_feature 1..22: note = Description of Artificial Sequence: Syntheticoligonucleotide
  misc_feature 1..22: note = MG3-7 guide sequence 9 for targeting Fibrinogen
  source 1..22: mol_type = other RNA
ataataagcagaacttttagtg

SEQ ID NO: 5571 - RNA, 22 nt, synthetic construct
  misc_feature 1..22: note = Description of Artificial Sequence: Syntheticoligonucleotide
  misc_feature 1..22: note = MG3-7 guide sequence 10 for targeting Fibrinogen
  source 1..22: mol_type = other RNA
gttttctttagttattaatttc

SEQ ID NO: 5572 - DNA, 3075 bp, synthetic construct
  misc_feature 1..3075: note = Description of Artificial Sequence: Syntheticpolynucleotide
  misc_feature 1..3075: note = MG1-4 sequence codon optimized for E. coli
  source 1..3075: mol_type = other DNA
atgaaaaagaaagttttcgcatttgatcttggtaaagcaagtattggttactgcgtccgtgacggatttaatatcaatgaagctaatagtattatcatcgataaagatcatgccgagaccatgtctctgcgtgaccgtcgccggattaaaaaaacactcgacgcccatcatgcacgtgaggaatacttcaacaaagtttggtcgggcgtaggcctcaacatcttagataaaaataacaacaacttcaaaaaagagtttccctctaaaaacgaggacgtaatctacacctcctgcttgctgcgcatcgcgctgctccagaatcaaaaattagaggagtggcagatttataaggcgctgtataatgctttccagcgtcgtggttacgatgttaatatcgcatggaagagcgttcaaacagacgacgacaaggaaaacatcgaacgcatgaaaaaatatacatgcgaaaacgatatcgaactgattatcagcgatgagtacaaatatccctgttactatgatgctttgcgtttgggcctgtggaacgaagatgaacccacgaaattgaaccgttcaattccacaacacaatagcaataaggtccgcactactgaatatgtcgcgccgcgcgaactcgtagaaaaggaactcaagcagctgtggttaaacgcgcagctgcaactgccccagttaaacagtatttcagccgaggaattcttatacggcgaatacaaaattccatatggtagctgcgtacaaaaggaattcaaacagtatcgtggcacaaaaaaagactggcaaggtgttctgtgtcagaagattccgcgcttcgataaccgcattattgctaagtgcaaactgctgccgaaacgcaacgtatgtaaagctaacactattgagaacgtaagtttcgtcctgctgatgaaacttaagaatcttcgcttcaccgtaatttccggtgaaaaattgcgtttgtcgccggtccagattaaacaaatttatgaaaactggcttgaaaaagtagaagatacgtataataaggacctggaaaaggccgaaaaattaggtaaagagaacccggaaaaacgcttgaatatcactattacccgccaggaaatcgagaaaatcattggggaaaaaattattgataagatcgaacccatgaaagcagatattagtggtcgctcgagtttttgtcgtcgtgcctgccaaatcatgaacaaaattatcctggacggcgaactctatccgcagaacgtggacattagtgagttcgtggaccgcgataacgcaaaaaatggcatcacggaagaggaaatccagtcaatgttatccaagattggtgactggaataacctgtatattccggataatcgcgaggaaaatgctcagaacgctagcaattcgcgtattaaaactgacattatgttaggcaacattaccaatccgattgtacgtaaccgcttgcagatctttcgtgatcttttgctgaacttggcggaaaaatacgggaccccggacgaagtcatttttgagttcgtgcgcgatggcgcagataactccctgtacggcagcaagaaggcacaggataccgaacgctttatgaaacagcaagagaaggaaaacgaacaaatcattaatgaactgaaagatgcgggcttatatgtcaacggtcaaaatcatgcaaatgccacgtacttcctgatgcacaaactcctgaaaagtcagggtggcaagtgtatctacagtggccaaaacatcagcccgtctaactatgacgaatgcgagattgatcatatttatcctcgtacgctgggaggcaacgacgctctctacaacaaagtggtttgttatcgtcgtgaaaaccaggacaaaaaaggccgcaccccgtatgaatggctgagtccggacagcgataaatgggctaattacgtcaatcgccttaacaagatcaagaaacagctggggaagaaaaaattcgaactgctgacctctaagccagaagattgtgaaaaactgatcgaaagttataacggtctcgcggagactagtcatattgcacgcgtagctcaacagatgactgctttcatctttggctggggtctgcagatccagggtgagagccggcgtattttcgtgaataacggctcttcgacctgtgccatccgcaaacgctatgggttaaacaaattactgggcgataacctgaaaaaaaatcgctctaacgataaacaccacgcccttgacgctatttgcatcagtttttctcgtgattttaaatatgacaaagaaattaaaaaagacatcattaagggtttcaatccggaaattgtcaagaacgcgatcgataaaatcatgccttatccctatgcaaatgataagccgtttaaaggtaacaccaaacccctggaaactatctacggtcttcgtacgtacggcgacaaaagttatattactcagcgcgttgaactgaactcgattgataaaaaagcgactaaaattaaatcgattatcgatgaaaccatcaagaatgacttgctgaataaactgaaggaaaacccgacagagcaggagtggaaactgatgctgcaaaattatattcatcctaaaaaacagactaaagtgaaaaaggtgatgatttctgtgtcagagggagagattactaaagatagcaacaatcgcgagcgcatgggcgaatttgttgactttggcacgaagggcactcagcatcagtttaaacattctaaacgccataagggccaaatcctgtattttaatgaaaaaggcgtcgtggaggtaatgccggtttattcgaatatcaaaaccacggacgtgaaagataaacttcagaatatggggtgtaaactgtataacaagggccagatgttctacagcggttgtctggttgatatcccaaaaccattcaaagcgggctcgaaggagtatcctgctggccgctaccaaatcaaaacgattcgcagtgataaagtggccgaactggaagacgcctgcggtaacaagatcagtacgaatgtgaaatacctggtacctgccgaatttaaaaaagtcgaaagcaaa

SEQ ID NO: 5573 - DNA, 3231 bp, synthetic construct
  misc_feature 1..3231: note = Description of Artificial Sequence: Syntheticpolynucleotide
  misc_feature 1..3231: note = MG1-5 sequence codon optimized for E. coli
  source 1..3231: mol_type = other DNA
atgcacactaaagagacggtttggggatttgatattggtaagggatctttaggtgaggcggtccgcgtcggcaacgaatttaagcacgtacttagcatggagatcgatgctgacttcgcagagatcaagacggccgcggctacacgccgcgcatggcgtacgcgtgaggcccacaaggcccgtgagatgtggcttgaaaagtgcctgagtgacgcggacattgagatcttaggccgtcgtaaagtggatatcgtggacggcacctggaagctggtttcccgtggtgacggccgtttagagcgcgagtttccggcggatggcgagaatgtatgctacaattctattgcgttgcgttgtaagcttctcctgggtgagaagctggagtcctggcaggtctttaaagctttaaattcagcaattcagaatcgcggatacgacgcgcaaatcccatggggcgacgaagacggaaagtcgtccgaaacaaagcgttccggcaagtccgattccgccaagaagtcgggcgaggatgaaagttatgcagagcgtctggcattgtttgaacgtgagttcgacaagctgttggcggaagtagaaaatcgtgagaagtatgacttcccgtgtttcttcaaggcagcgaagatgggactttggtcaccagagaaccctgacaaggtcggcatccgtattgataataccgcggagaaggcaaagggatatgtggtgccccgcaatgcggttatcgcggagtttcgcgcgcttgttaatgctgccgcaaaacaatacccgaagttgaagggaaaggccgattttatcatgttcggaaaggccgaagaagcatacgcctcgtacaagcctgaattacgtcgcaagtttggcctgcgccgcggcgctgattcagactggactgctctcggtcagaaaacaccccgcttcgacaaccgcattatcgggaagtgtaagcttatcccgcgtctgaatgtctgcaagatcaaacctctgaaggagtgtaaggccgaggatgatttcttaccgcatacgatcacgctggccttgaagctgcttaatcttcgcttcttccgtggcgccggcatcgactcgttatcgttcgacgagtttcttcgcgcctttgaaattgcccgccaaaataagtttgccctgaacaagacgaatctcaagaagttcttcaagactatcggagcggagattatggacgagaatcaatccagtgtggaacagccccgcgagggtgggcgtgccagctacagtcgtccagcgatgcgccttctccgcgatctgatcttcagtgggaagtccccggctgagttctacgcatcccgtatttgcaagattgagaataccgataagaatcgcggactggttgcggaagacttggcgttcattaaattgatgggtgatattccctggaacggtatctttgttccagacgttgacacattcaattttgcgaatattcgcgagtccgagcgtgcagataagatcaacaagctgattggcagccaaaatgacccaatcgtgcgccaccgtctggcattcttctatgagcgcattaagctgcttgaatctaaattcggagcacccgacaagatcgtgttagagtttgttcgtgacgacttcttagggtctaaggcaaagaaagagatgtcgcagggtatcaagaagcgtttcgaggaaaagaagaaacttgcagaggagttagacagtcagcgtgccgagtttggtaacaaatacgcgtccaagaagatgcttttaaagtttgagctgtataagaagcaacgcggacgttgcgtgtacacggacaatgcgttgccgctgtctgaacttgagaacttagaggttgaacacattttcccgcgcagccgcggcggcgccgacgcaatgtacaactatgtccttactgacgagaacactaacaagcagaaaggggacaagaccccgtttgagtggttaagcagcgacaagacaaaatgggaatcttactgtgatcgcgtgcgtagtttaacccagagcctgggcgccaaacgctgcaagttgcttgtaagtccaaatgcagaagagctcatgcagaaatacacagcgctcgccgagactgcctggatctccaagctggcgcaaaagatttgctgtatccacttcggctttcagtttggcggcttaaagggtgagaagaaggtctggactgtgagcggaaataccacggccatgattcgtggccgttacggtttaaaccgccttctgcataatgaagagatcagtgaggacctgccgctgttagatcgcatcgtaaaggaaaagaacttcgaggaaaagaatcgtgataataagaagcaccacgcgttagacgctatgtgtatctgtttcgcgcctacgagcaatgcgaagaaagcgctctcacgtaagaacatcttgcccgaggaaattgcaaagaaccccgaatccgacgacgcccgtaatttcttcgcgaagtatctggccgaggttgttcccactaaggtggcgattaagaagccggagctggagcaaacaatctactccaagcgtgtaatcggtggccgtcaaactattgtgaagaagtgtaacgtgcgcgatcttgcttacaagggtcaaaacccaaagtacgacttcgacacgcttacgaagcgcatcaaggatatcatcaatccggttagcaagcgcgtcattgaagattttgcgaagaccgaaccaaccgaggcggagtgggaagattggtgtaagtacgaagcggcaatcccaagtaagaatggttctccgacgcgcttgcttcgtgtattatgcaagacgaaggacgatgccgagcgttttaaggatttgtcaaaggatggctgcggtgcgtatcgtaagtccaagtcgcacaaaggccagtttatctggaaggataacaagggcaattatctcgttgctccggtttacatttacagcagcaagcagaaggtgtatgcggaactcaagaataaccctaagtgtatgggcatttgcgatttcttcaagacgggctgcctggtgaagatcagcaacgaggtggttgacgagaagaagaatcgtctctggttaaaggcgggcttttacaacctcaacagcatcgccaaggagaagcgtgtgtatcttaccgatgtaaacggccaggagcacaagaagattccgctgcaacatttgatgaacgcaggaatgaagcgtgtcgagacgaatacaatc

SEQ ID NO: 5574 - DNA, 3177 bp, synthetic construct
  misc_feature 1..3177: note = Description of Artificial Sequence: Syntheticpolynucleotide
  misc_feature 1..3177: note = MG1-6 sequence codon optimized for E. coli
  source 1..3177: mol_type = other DNA
atggagaaagaaaagaacaaccatgtttggggctttgatattggcaaagggtctctgggtgaagcagttcgggttggtggcgattttaagcatattgcctcagttctgcttgacccggaatttggggaaatcaaaactgcggccctggctcgccgtcagatgcgcacacggaaagcccataaagctcgcgagaaatggctcgaggagtgtctcgacggcaccggtgtggagattctcaaacgccgcgaagtgggaattgttgatgggcagtggcgccttatctcgaaaggtgatgaacgcctggaacgcgaatttccgccgaacggcgaggaagtgtgctacaactctattgccctgcgttgtaaattattgctgggcgagaaattggaagggtggcaggtctttaaagccctgaacagcgctattcagaaacgcggatacgatgagaatatcccttggggggaagccgaggaaaagtccagcaaaaaggacgaagatgattacgcgcagaaattaagccaatacgagcgtgaaaaatctgaactgtttgaaagttttgctgatggggaaaaatacgactttccttgctttttcaaagcatataaaatgggtctgtggagtccggaaaacccgcgtcgcgtcgaggtccgcattgattgtcgtgcgcaaaaagcaaaatcgtacgtggttgcacgcaaatatgtagaacgcgaatttgaatgtctggtggaagcggccgcgaaattttttccgaaactgaaaggccgcgcgaaattcatcctgtacggcgtctctgagaccccgtacgcatcttactatggtaacatgcgcaagaaatttggcctgaaacgcggagcggagagcgattggaccgctcttggccaaaaagtcccgcgttttgataaccgtattatcgataaatgtcgcttaatccctcgcatgaatgtctgtaaaatccgcccactgaacgaagctcgcaacgaaaaggacctgctgtattatgaggtgaccctggcattgaaacttcttaacttgcgtttctttcgcaactcgaacatcgaacagctgaccttcgaggaatttaaaaaggcctttgaaatcgcgtctggcgccaaatacaaaatgactaaaacggcaatgaaaaaatttctcaaatctatcagcgccaccgcgttaggtgacgattatgcagaaatcgaaccgcctaaggagtctgggcgtgcttcgttttctcgtccagccatggatattttgaaagaactgatttttagcggaatgccgccgcgtgagttttacggccgcaaaatccctgagatctcgaacacggacaagaacaaaggggttgttgcctctgatctggactttatcaaacttatgggcgactgcccatggggcgggatttttatcccagacgtacagacctatcagtttgcgaatgcggcgttcccgaaccctgatgcacagatcaataaactgattggtagtcagaacaaccctatcgttcggcaccgtctgaccttctttttcgaacgcatcaaatttcttgaaagcaaatatggcgtgccagataaagttgtgctggagttcgtgcgtgacgattttatgggagaaaaagaaaaaaaagaaatgcgtatcgctatgaaaaaacgcgctgaagaaaaaatgatgatcgccaaggacctcgacgagcacggtttcaaaggcggcaatctgctgcttaaaatggaattgtatcgcaaacagaatggcatttgcttgtacaccggcgacgcgctgcccctttcagagctcgcgactcttgaaattgagcatattgtgccgcgttcccgcggcggtccggatgcacaatacaactatgtaattacccgtgaaaaaaccaataaattgaaaggggataaaaccccatatgaatggctgtcctcggacgccaaggagtgggcctcatataccgatcgtgtgaacgcgtgcgcgaaagctctgggcaaaaaacgttgtcgtctgttgctggagaaagacgcagaggaattagtcgagaaatacaccgcgctggcggaaacggcccatatcgctaaactggcccaaaaaatcgtctgcatgcatttcggtttccaatttggcggtttgtccggcacgaagcgcgtatttacggtccctggggccctgaccagccggattcgcaaattctacggtctcgatcgcattctgcacaacgcggcagcggaaagtgaaaatctcagctttgaagaattcttgaaatttagtgaagatctggagaagaaaaaccgcaaaaataaaaaacaccacgccctggatgcgatgtgtctgtgttttgctccaaccggggtggacagccggcgcgcgaaactgggggaaattttaccggaaaagctgcgtagtgaaaaagcagcccgcgagttcttcaagtcttaccttgataaaatcatgccggtcgatgtggctcccaaaaaaccccgtttggaggacggcatctatagtaaacgcattattgggggtaaagcctgcatggtgaagcgtaacaacttggttgatctggcttataaaagcggcctgaaaccggtgttcgacatcccgacgctgatcaaattagttgacaaaaaggaaaagggcattattaatccgcagattcgtaaaatgattggcgaatttgctgccaccaatccggacgaatcagcgtggcgtaaatggtgcgaagaggtacgtcttccgagcaaatctggcctgggtgcccgcgttttacgcgtcctggtgtactacggcgaagccgatgaatataaggatctgagtaaggatggctgtggtgcttatcggaaaggcgacggccataaaggccaggtggtgtgggaaagtgtggatggaaaatattacgttgaaccggtctatgtacacgcttcgaaagcgggagttatggcggccttgaatgcgaacccgaagaaaaaacgcatctgcggtatgtttaattcccattgcaccgttgatgtcggcgatgtgtacaacgatcgcggcgattttattcttccagccggccgctacatggtcaataccatcctgacgaccgggcggtgtgtcttgaccaacgccgacggtgaaaaacgcaacccgatcaacattaactacctgatgcgcgctggtatgcgccgcgtcgagttaagtgaactg

SEQ ID NO: 5575 - DNA, 3183 bp, synthetic construct
  misc_feature 1..3183: note = Description of Artificial Sequence: Syntheticpolynucleotide
  misc_feature 1..3183: note = MG1-7 sequence codon optimized for E. coli
  source 1..3183: mol_type = other DNA
atgaaggtgatggaagacgagggtggcaatcacatctggggctttgacatcgggaaaggttcgctgggcgaagcggtgctggacggctcagaattcaaacacgtggcgagcctgctcctggacgctgactttggagaaattgagacagccgccggattacgccgtcaaatgcgcacacgcaaagcacacaaggctcgtgagaagtggcttgagtcctgtctgagcggttttggtattgaaacattgaagcgtcgtgaggtcggcatcgttaatggccagtggaccctcatttcgaaaggggatgagcgcctggaacgtgagtttccaccagatggtgagaacatttgttacaacagtattgctctccgctgcaagttgttactgggcgaaaagctggaagggtggcaaatctttaaagcactcaacagcgcgatccagaatcgtggctatgatgagaacatcccgtggaaggaaagcgatgctagtccgtcgaagaaagaaggcggggactatgcgcagaaactgtcacaatactctcgtgaaaagtccgagcttttcgaatctttcgagggtggtgagaagtatgattacccctgtttctttaaagcgtataaaatgggcctgtggagccctgacaacccagaacgtgttgaagtccgtattggatccgatgcacagaaagcaaaagattacgttatcccgcgtaaggatgttgagcgcgaattcgagcgcctggtggaagccgcctcgaagtggtaccctgccatgaagggcaaagcgatgtacatcatgtatggtatcgccgagaccccatatgctagctacaagcccctgctgcgtaagaaattcgatttgaagcgtggggcagagtctgattggaccgctctgggtcagaagattccacgcttcgataaccgcatcattgataagtgtcgtcttatccctcgtcttaatgtgtgtaaaattcgcccactgtccaagattcgcggggaagccgacctgttacactatgaaatcacattatcgctgaagctcctgaacctgcgtttctttcgcaactcgaacgtggagtcactgagcttcggagagtttaaagcagcattcgagattgccaagggagccaagtataaaatgggaaaagccgccttaaagaaattcctgaagagcatctccgccagtgtcttatctgaagatcaatctgagattgaggcgccacgtgaatcgggtcgtgcagccttcagccgtccggcgatgctgctgctgaaggaactgattttctctggtatgaccccagcggaattctatgcaaagaaaagcggagagatcagcaacgcggaccctaataaaggaatcgtagcctcagacttagacttcatcaaactcatgggtaactgtggctggagtggcatcttcatccctgatgtagatacatttcacttcgccaataagggagcagaaccagcgaagttgatcaatgaactgattggcagccaaaataacccaattgttcgtcatcgcctgagcttcttttatgaacgtattaaattcctggagagtaagtttggcatcccggataaagtagtattagaattcgttcgtgaggattttatgggtaaggaacagaagaagcgtatgcagattgagatgaagaaacgtgcttctgaaaagatgttgatcgccaagaaattagatgaagccggctataaaggtgggaaccttcttctcaagatggaactgttggagaagcaaggcggtgtctgtttgtacacgggtgaaccgcttttgccttccgaactcggtgtgctggagattgaacacattgtaccacgttctcgcggcgggcctgatgctcagtataattacgtccttacacgtgaaaagacgaataaagagaaagcagatcgcactccattcgagtggctgtcttcagacccggtcaagtgggctggttacagcgatcgtgtgaaagcccgtgctggtcaactggggcgcaaacgttgtgagctgttgttagagaagaatgcggaagagttggtagagaagtacactgccttagctgaaactgcccacatctcgaagctggctcagaagattgtgtgtcttcactttgggtttcagtttggcggcctgagtggcacaaaacgtgtctttacggtccctggagcattaactgcacgcatccgtacgttttatggcctgaacaagatcttacataatgaagacttggcccacgaaacactgagcttcgagggcttcctgaaacgtggtgaagagttagataagaagaatcgcgcaaacaagaagcatcacgccttggatgctatgtgtttgtgcttcgctcctacaggggtaaatagcaaacgtgcccgtgtggacatgctcctgccaccaaagatccgtagcgagaaagaagcggaacttttctttcgtaaatacttagataaactcatcccagtggatgtcgcaccaaagaaacccaagctggaagatggtatttactccatgcgtacagttggtgggaagaaaatcatggcccgccgtgtaaacctggttgacctggcatacaagagcggcctgaagccggtgtacgacgtatcggtcctgatcaaacttcttgataagaaagagcgcggcatcattaatcctcagatccgtaaactggtagcagactttgcccgtaccaacccaagcgaagatgagtggaagaaatggtgtggtgagtgccgtttacctagcaagaatggtctgggcacccgtgtaattcgcgtgctgctgaactatggtgagccggcggagtataaagacctgagcaaggatggccgtggtgcatttcgccgcggtgatggtcacaagggccaaattgtgtgggagtccaccgatggcaagtactgtgttctcccaatctatgtgcatgcaagcaaggccaaattattagcagaactctgtgcaaacccgaagaagaagcgcatttgtggtattttcaccagtcattgcatggtcaaggtgggtaacacctacaacaataaaggtgagttactgctgccggaaggagtttacatgcttaacaccattcgtacggatggatggatccagctgacgtctgccaatggtgacaagtcaaaaccaattaatattaactacctcatgaaggcgggtatgaagaaggtccctgtgaaggattta

SEQ ID NO: 5576 - DNA, 3999 bp, synthetic construct
  misc_feature 1..3999: note = Description of Artificial Sequence: Syntheticpolynucleotide
  misc_feature 1..3999: note = MG2-1 sequence codon optimized for E. coli
  source 1..3999: mol_type = other DNA
atgccaaccaccaacccctatgtaatcacacacgtgacgaagaattggatgaaggatgagttttacgattcagctcttgtcctcggtttggatattggaattgaaggcatcggcgtttggttgcggaaaggccgcgaaccgctttttgcccgtacattcatggtttcgctcccggaagcggctccgctgaagaatcggcgcgccaaacgagcacaacgacacgcccggcagagcctccgtcgtcgtgaggccatgttgcgcgagtgggttgttcgctacggcttgcttccccaggaaaaaactgacggacggtggtggaagaaccctgccgtttttgagcgggccttcgagcatcgtcatcgagcgattaccaccggggtagccagtcctgaatgtttagtcgtatgcatccgtcacctcttgcggcatcgcggttttgattatcacctgaccgacgagggggctttcccgtggggtgatgaattggatgataaggaaatcatccagtgggccaagaactcgtgttgcgcaccggagtatcgcactcatttgtgcaatttgatcgaggccgacgctgcttgggcgaaaaactccgatggctcatttacggaaaagtatctcaaagtgcgacaggcactggatgatgccgtgagggaatacgagaaccgaccggtcgagcggatgttggaacagcatatgagcgagaagaatcatccgcatctgcggcctcgcgcccgtggacgcaatttcgcccgtgagcttgttaagcagcacttatatgccatttgcgagaaacatcgccacttttttgcgcccggcactttcgaccaagcgatgcgggaattgctgggtgaccagacaggaccaagtcagtggaaactgacgtggatggatcaagacggcaaggcccgacaaacgatcctcgattatcaccggcgcacacgggaagaggccgaagagctttggaagcgcaaagtcaaaaaatgcccgtttgctccattgctgtttgaaaagcggcatccgacgactccacaacacgactgcgctgtccgtagcgacccacgaatccgtcgtttcaacctactgatgttcttagctgaacgacggatcgaactggagacccacgacgcggaaggacgactccaaaatccgcgcgtgaatcttgatgccaacgtcgtccgcgatttgttgggcgatttggagcaagatattcgggcggtcgaagccttgcgaaacaagcagtcagcgtcccgaccagacaaaccggggaagaagacctttgaacagcgatggcgcatctgtaacgactgcggcaaggagactggacaagatgagacgggcaagagttcctgttgcaaagctaagacaaaacccaaaatgccgctcgctggggtcgctaaggggtcgttcaatgctgactttttcgatcagttgggtgacttgttgcgacccgaattgcgttccttgaagggacgggcgagcctgtccggcgaggcggcggaagtgctgttcaagctcgttaccagaaacggtacagacttcgagcctgctagaattcgccaagcgttggaagactgcggctactacgattggcgtaccaatctgccggccggccttggcatctatccgcaagtgacgttcttgttaggaaatcgcggtcattacgacaaggacggcaaccccaggcagatcgacaagacgacaggcaaccccgtacatcacggcatcctgcgccggctgtttgcgggccagttgcgtctcgacgatgggacattggtgggtctgaaggataaactcgacgataaggttgtgcccgattacgtggtcatcgaaaccattggcgagattccgaaaaaccagaaggaaaagaaggagtttcaagacgaaatcaaagccaaccggtcacgaaaaaccgacatcatcgagaagaaatacggtctgaaactcgattcgctttctgactggcaggtgaaacaagtgttgctgttcgaccagcaagccaatgaggaaggcgaagcgttcagcccctacagcggcgtgtccctcggcacaaacccgctggcgcatgatttggaggtggagcacatctaccccgaacgacgcggcggtatcagcgtcatggacaatttggttatcacatggcgcacagaaaaccaaaccaagggagaccgaactccttgggagtgggcaaaagacgagggttggcgggtggacgtccatttgcagaagatgcactggagtgcgaacaagcgcgctctatttgtccgccaagaaagcgatccgccgcagtgggacaacaccacacggatggcccaacttgctcggcatctccgcgccgaggtcatccactggcttggtttagaccagatccaagatcaaaaggagcgtaacaaggaaatcgcccgccgcatcgggacgccgaccggcttccaaaccagcgtttgccgcgagtcgtggacaccaccccatgtgtttccccaaatgtatcggttgctctgcgacaagaagggagtcccggtgcgcgacaggaatggacaagagcgatgggtcaaagaccgcaccaatttgcgacatcacctctgggatgccgctgtgctttcgcatattccaccaggtgtggggctgaattccgccgattgcggcggcattttcgtccaccgtcgcgacccgcagaatggcgaatggtcggtttcggcgttagcggatcttggccctgacctggtggcgtttgaaaaggccaatgccgaccgttgtttagtggtgcgcctgcgccaacgcaaatccaaaaagtcccgttacaaagaaaccatcttcagcctgccggatcaacagaacagggtctttgcacgcgaaccattgagcaaggtcgtcacatctctcttaaagagcaagaagaagaacccggatgcagaattgcggaagctattggaccggccggggcttctcaaccccctcgaaatcacaaacaaaaagacaggccaaacgaaacaaatcaagttgctgaacaaggccgacgtagaacgttggttatcctgcaaagacgtctcactggatcaagaaggattccgcaaattcatcgaggatgtgggcgtgccgacggagcaaatcccagacgacgcggtgaaagcggcgttcatgaagagaaatggcgagacgttacttcgcaagacgttcaagcccaactcccttgtaagttttattcgacagaaatgtcgcatcaaagattcagaaatcgaggcccgtgtggaaatagctatcgccgaacgaaatgaacgcaccgtcctgcgggcggctaacggacgagacggacagcccggtcaagtcatccgcagcattcttatcgagcaagacaagttgccgccatgcggttttggcctacatttcaatcccactgccaaacccaaacgcgggagcgaagtcgctgggttcaagcctgtggacaatagtaattccgttgtctatctgcgccgcgaaatctggatcggccaacgcaccaaaaagaaaggcagaaaaacaaccgtggagaccttctacaagtcgcgcctcatcccacatccacgtcacctcgcttcgtaccagaaacttcacggccagccgtggaaagccgacccgttaccgctaggaatgaaactggccggcaagctggccgttggtgacctgctccgtattccgttgaaaaaagaaaaacgaaatcgcaacgacaatttgatcgcgaagcgcggtgaaaccccgctggagtcgaggttctaccgggtcaagtcaatgaagaccaacggcacgatcgaattccaaatggccgagtttgctgaaccaaagttggtaaaagggcaaatccccgatccggccacggaacggttattggaaacctacgagttgacgtgcagcaacgaggccgatttgctctggttgctggaagtcacgacaggcaagagaatcaaacttccaccgccggtcgtggaaaacgctccgaccactgggaaacgggagggcgaacttctg

SEQ ID NO: 5577 - DNA, 3240 bp, synthetic construct
  misc_feature 1..3240: note = Description of Artificial Sequence: Syntheticpolynucleotide
  misc_feature 1..3240: note = MG2-7 sequence codon optimized for E. coli
  source 1..3240: mol_type = other DNA
atgaagcaaggtcagattgcgttcagttttgacattgggcattcatcaatcggttgggcagcgttccaagtgagtgatgcaccgggtacctttcacagtctgctgggtaccggggtagtgttattccctaaagacgcatgtttggccagcgcacgtcgtgggtttcgtcgtagtcgtcgtaatattgcggcacgtcgtagccgcatcgatcgtcttaagaattatctcgcaggccttggtgttctgtcgcgtgatcaattggacgcgaatagcaattcctacccatggttgttggcggctcgcatccttgcgtcggacggtaagaaaaccttaacctgggaagagctgtggagcgtactgcgttggtacgcacataatcgtggatacgatggtaacgcactgtgggccggagacgatgccgacgcgggagacaaggaagatactgacaaagtaaagaatagcattgcacttatggagaagcataagacggcaacaatggctgagacggtgtgtaaagcgttaggccttgatcccatgggagaggttaaagcatctcgtatttactttaaaggtaataacgcagcgtttccacgtggtgttgtaactgaagaggttcgtcgtatccttgcggcacacgctggtaagctcccgaaagttgacgacgcactgtccgacatcttactgcgtaacgcggctacaagtggactggaacttccggcgcgcttcaagggtggtttgcttttcggtcagtatgtgcctcgcttcgataatcgtattatcccggcatgtcgtattaccggcaagaatacgccattaaagcgttgtccagaatatctcctttatcgttggggtcgtcttttaaataatctcactgtctttggtgccgatggtcaaattcgtactttattaccggcggaacgtcaggcgctgcatagccgtatggaagcggatgggttctttacaaagcgtacgttgaacgcggctttaaaggatgttaccggctgcacaccagcgaacacggagtccttcttcttaaccgaggagatggaagaagccttagtgttagatccggtgaagaagcttttggccactaatcaaattatgaaagacctgtggccgcagttatcggcagagtctcgtgagaaagctcagagtagtttaagcgctggtaagaaaattcgcttgggtgacatccttgctgagatggagaccgcaggccaagatactacggcggcgtcggatgcgcttgcgtcgcatcaaaagaaggctaagaagaagaatgcggacctggcgactcgtcgtctgagcgcggactacccgaagggccgcgcggcatattgtcgcgagattctggcgaaaacgtttgatgagtccattagcggaaaggattcgaccaaagagggcgggtgtttatatgagacggaagagattcgtaatcgtctcctgcgcgagcctctcgtgcaacaaacaaacaatcatctggttcgccaccgcctgttggtctttgagcgtctgctggcacatatggtagaagaattcgcgggtggagatgagaagcgtatcgcggctactgttgttgaggtagtccgtgagttgcaagagtttagcggtttaaatagcaaggagattacccacaagttaaacgagaagctcggtaactttcgctctgtggtaaagaatctcgaagaggctatcgcaaatagtgaagagcgcgtggcaatcactggatcactcattcgtaaggcgcgtattctcgaagatcaaggattcgtgtgtccgtacaccgggacccacttaagttataatcacttgcttgccgatcgtctggagattgaacatattatcccgcgttcgttgcgcccgtcggatgctcttagcagttgtgttatgacgtttcgtagcgtaaacgatatgaaaggtcaacgtacggctatgcagtttatttgtgaggaacaaggccgtgaagtgcctggtcatgagaatattcagattaccacgaagaaagcgtatgttgactacgtagcgaaacataagaagcagtatccacagaagagtgatgaccgtcgtcgttgtgagcgtcgcgccgagttgatgttaatggaacgttacgatcaacgtaatgcggattttacagaacgtgatcttacacagactagccatctcaataagatggctattcgtcttgtgaagcaacgtattgggattgatgcgaagcatttaccgggtaatgtgacggcatttattcgtcagaagctgcacatcgatgagtgtttatttaacgcggtgccgcgcttacagacggcggcaaaaggtcagccaaaatccagtaagcgcaagaagaaggcagaagaggctccggtggaacctattcaggatgatatgccgccgcgtaaattaacgaaagcggatattcgtgaattgacttatctccaccatgcgatggacgcagtgacgcagggattagctttgttattatttgcaccggaagattggccgctcttggtaaagcgtaatcttccggacagcgagcagcgtcatctgaaggcccgctacccattcttggacttttcggcagacaaacatattagtattcaggatttaccggaagatactctgcatactatttcggaacgtcttgctgagtgtcgcgtggttcgtcatatcccggcgaagatgcatggtattattgttgatcaaacaacgtggggcacggttgcggctggggctattaccaccctgcgccaaaagactactgaaaagaatgcgcgctgtgacgagaatggtaaacgctttattaaaactacagagaagaagcgtagtctgctgctgggcggtcctgatgcgccagatggcaaacttgcaaagatcaagggtgccattttagttaccgagaattggggttgtgcgctggatccgagcccgacggtaattccgcactttaaagtctaccctcaactgcgtgcattgcgtgaaaagaatggtggtcgtccgattcgcattttacgtaagggctcattaatccaagtgaaagccggcacgtaccagggtatttggagcgttgcaagtattaaagacaacgcagacggtatctgtctggacattaacgccgccgataaagtgaagttagaaaaccgttcagacgacagcaagattaacgttcgcctcgatagcctgcgcaagtctggcctcaaaatcttgaagcccaaactcacaggcgcctgcccgacgacaagcagcccg

SEQ ID NO: 5578 - DNA, 3402 bp, synthetic construct
  misc_feature 1..3402: note = Description of Artificial Sequence: Syntheticpolynucleotide
  misc_feature 1..3402: note = MG3-2 sequence codon optimized for E. coli
  source 1..3402: mol_type = other DNA
atgtgcattaacggtgactcgatggccgcagttagcggctttagcccgtgcaagttcgggatcgggatcgacgtgggtgatcgttcggtgggttttgcgactatcgaattcgacgacgacggttttccgctctcggtcttagccagcgtcagttacaaacacgatggcggcctggatcctacgaagaataagaacccgattagccgcaaggcgactgcaggtgttgcgcaccgcgtgcgtcgcatgcgtaaacgccgtcgtcgccgcctggaaatgctggatgtgaagttacgctctctgggcttccctgtcccgaatggcgaggagccgcaaacttaccaagcatggcaaagtcgtgcaaaattaatcgatggccgcgtggacgaagtacgtgaactgaacgaccacctggtacgtgccgtgcgtcacatcgcgcgccatcgtggctggcgtaacccttggtggcgttttccgcaactgcttgaggcctcagaaaaccccagcgacgcgctggtagcgatgcgtcgtgaagcggctcaacgctggccaggccaggcgttagaaagcgccacaatcggtcagctgggttggcttggtgcacacccggatgttttggttcgcccgcgctcggcacgttcggaagttcccgtacttagctcccgtgtcatgcaacaggatcagtgtgcagaaatccgtcgctactggcaactgcaggatctccctcaggaagccctgcatcctatcctgaaagcggtctttcatcaggaaccgccgacggtacctgcggaacgtatcggccgcgacgccttaccggggcaagatgcaccgcgtgcgattcgcgcagcacttgaattccaagaatatcgtattcgtgacgcggtggccaacttgcgtgttcgcaccggcggcgcaaaccgcaaacgcaaactgactccggaagagaaccatgcggtagttaaatacctgatggaatttcgccaaaatccaagcccgtcttgggccgaggtagccgaacatattgacatcgcaccgactagcctgatcgcacctatcattgacgatatgcgcatcgcagcagctccaaccgaccgtagcaccatcaccgccgaagcggtactcagcaatatgaagaaagactcgggcgcccgtttatggtgggaatctgccgaccagaaaatgcgcagcttgttaatccgcttcctggccgacacgtccgactatactcaaccagaggcagagatggcaggtctggtagacatcgtgagcacctggccggattccgaaattgaaaagctgagtagtgcatcatggcaatcgggacgtgccgcgtattccttgcaaagcctggaacgtatgaatgcgtacatggcggagtacagcacgggagcgcacgaagcccgcaagggtgtgttcggagtagatgatagttggaaacccgaggcggatccttgggacgcccagaccgggcagcccgtggtggatcgtgtaatgacgatcgtacgccgcttcgtaggtgcgtgcgagcgtaaatggggcgaaccggagcgtattgtaattgagcacgtacgcacgggtttaatgggtcctgcccagcgtgcagaagtactgcgcgaaatggcaagcgggcgccgtaagaacgatcgcatccgccaagagcttcgtacctcaggtatcgatgagccaaatttgtcggacgttaaacgtcaccgcaagatccaaatgcagggcggcgtgtgtttgtactgtggaaccgacatcacaagcgccactgcggaactggatcacattgtcccgcgcgcgggcggcggaaactcgacgtctaccaatttagtagcagtttgtcgtgtatgcaatgctgcaaagggccgccgcacctttcccgaattcgcaagcagcgacacccgcgacgccgtatcgcttgaagcggcggtagagcgtgtgaaactgtggatcgacgataaaggtattaagaatattggcgaatcacgttatgctcgcgatgtcatccgtcgtctgaaacagtcgacacaagatgaacctatcgatgaacgttcacttagtgcgactgccttcgctgcggttgaaattcgtcgcaaattagaaaaccactttaaagaccgtacaaagccggtgcgtgtggatgtttaccgcggcgcccttacgcgtgaatcgcgccgtgcaggccgcattgacgcgaagatccgtttgcgtggcaacatcgacaaagatcgcctggatatccgccatcatgcgattgacgcggcagttctgacattactggatccatccgtcgcaaagaccctggctatgcgtttagacctgaaacgcgaacagcaggacagcggtcgtgacacgcgttggaaggagtttaagggcttaacaccagcgagccaagaacgttttatcaaatggtgccaagcctcggagtgccttgctgacatgttacgccaacaaatcgaggccgatcgcgttccggtcgtcgtgccattacgtattagcccgagtaatggtgcggtacacgatgattcggtgcgtcccttgacgcgccaaaagattgactcgacttgggaccgtaaatcaatcaaccgcattgttgatccggagattcatgtcgcgatgcgccgcttgcttaacaatgggaccagtctgcccgaggacaagaaccgcgttttggacttacctgacggcaacgagcttggtccgcatgacgaagtcgaacttttcagtacttccgccgcctcaattaagttacgtcgcggcggaagtgcggaaattggcggtagcattcaccacgcccgtgtgtacgcgtggatgggtgctaaaggccaacttgagtatggcatgatgcgtgttttcggtgccgaattccccacgctgactaaattatccggatcaaaagatattctgcgtatgcccatccacgccggtagtatgtcatatcgtgacatgcaagaccgtgtccgcaaacctatcgagagcgatatcgctgtcgagttgggctggattacgcagggtgacgaattggaaattttacctgaagcacacctggaaaccgccggtggcctgggtgactttctcaaaagtttcccggaaacccaatggaccatcgatggcttcaacgacccgagccgtctgcgcgtacgcccgcgtctcatgagtctcgagggacgcgatacaattgatgcgatgggccatctgagtgatacggaaaagctgaaaattaaacaagctctgagcaagggccttatggtgtcagcaagtgagttgttatcgcatggtgctaagattatccgtcgcgatcaccttggccgtccacgttggcgcggtaacgcgcgtccggtcagcattgaattagagcaggtggccaatcaattagtaaaccatcgtagcgtcgacggccaa

SEQ ID NO: 5579 - DNA, 3396 bp, synthetic construct
  misc_feature 1..3396: note = Description of Artificial Sequence: Syntheticpolynucleotide
  misc_feature 1..3396: note = MG3-3 sequence codon optimized for E. coli
  source 1..3396: mol_type = other DNA
atgtcagccgactcattgaactatcgcatcggcgtagatgtcggtgatcgttcagtgggtctggcggcaatcgagttagacgacgatggcttccccttaaagaagctcgcgatggtgacgtttcgtcacgacggtggcaaagacccggccacgggcaaaaccccgaaatcccgcaaggagaccgccggagtcgcacgccgcacgatgcgcatgcgccgtcgcaagaagaagcgcctgaaggatcttgacaagaaattgcgtgacttaggttacttcgtccctcgcgacgaggaaccgcaaacctacgaagcgtggtcatctcgtgcccgcctcgccgagtcccgcttcgaggatccgcacgaacgcggagagcatttagtgcgcgctgtacgtcacatggcgcgccaccgcggttggcgcaatccgtggtggtctttctcccagctcgaggaagcttctcaggagccttccgagacatttggacgtattttagaacgcgctcaacatgaatggggcgagcgcgtctcagacaacgcaaccctgggtatgttgggcgcgctggccgcaaataacaacattctgcttcgcccgcgtcgttacgaacacaacccgaagacgggcaagaacgcggagaagctgaacgtacgcggacaagagccaatcttattggacaaagtccgccaagaggatgtgctcgctgaactgcgccgcatttgcaaagtgcaaggcatcgaggatcagtacccggagctggcccatgccgttttcacccaggtgcgcccatacgtcccgaccgagcgcgtgggcaaggatcctctccagccaatgaaaatccgtgccagccgtgcaagcctggagtttcaggagtttcgcatccgcgacgccgttgcgaacctgcgcatccgtgtaggcggtagcgagcgccgtccgctcaccgaggaagagtacgaccgcgcggtcgattatctgatggaatattcggacacaacacccccgacctggggcgaggtggccgatgagctcgagattgctgagaatacattaattgcgccggttattgacgacgtccgcctcaatgtggcgccgtacgaccgcagtagtgccatcgtagaagccaagctgaagcgtaaaacgcaggcgcgtcagtggtgggacgatgacgctaacctggacctgcgcagtcaattaattttattagttagcgacgcaaccgacgacacggcgcgcgttgcggaaaacagcgggctccttgaagtattcgagtcgtggagcgatgaggagaaacaaacgctgcaggacctgaagttcgacagcgggcgtgcagcgtattccattgacaccttgaataaactgaacgcgtacatgcacgagcaccgcgttggactccacgaggcacgccaaaacgtctttggcgtctctgacacttggcgtcccccgcgcgaccgcctggatgagcccaccggccaacccacagttgaccgtgttctgacgattgtgcgccgtttcattttggattgcgagcgcgcctggggccgcccccagaaaatcgtagtcgaacacgcacgcacggggttaatgggcccgtcgcaacgcgccgacgtgctgaaagagatcgcgcgcaatcgcaacgcaaacgaacgcatccgtcaggaacttcgcgaaggtggcatcgaagcaccaaaccgcgcagacatccgccgcaattccatcatccaagaccaggagagccagtgtctgtattgcggcaaggagatcggggtgctcaccgcagaactggatcatatcgtcccccgtgcaggcggcggtagtagcaaacgcgagaatctggcggcggtctgccgcgcgtgtaacgcctcgaaaggctcccgccctttcgcagtttgggccggaccagcccgtctggagcgcacaatccaacgtttgcgtgagttgcaggccttcaaaaccaagtcaaagaaacgcacacttaacgcaatcatccgccgcctgaaacaacgcgaagaggacgaaccaatcgacgaacgttcactcgcgtccactagttacgctgccaccagcatccgcgaacgcctggagcaacacttcaatgacgacttgcctgacggtttcgcgccagtggccgtagatgtatatggcggcagcctgacgcgcgaaagccgtcgcgcaggcggaatcgacaagtccatcatgttgcgcggtcaatcggacaagaaccgtttcgacgtccgtcatcatgccatcgacgccgcggtcatgaccctgctgaatccgtccgttgcagtcacccttgagcagcgccgcatgttgaagcaagaaaacgactactcgagcccgcgtggccaacacgataacggctggcgcgacttcatcggccgcggcgaggcgagccaaagcaagttcttgcactggaagaagaccgccgttgtgctggccgatttaatttctgaggccattgagcaggacacaatccctgtcgtaaatccactgcgtttacgcccgcaaaacggctctgtacacaaagatactgtcgaagcggttttggaacgtaccgtgggcgactcgtggacagacaaacaagtaagccgcatcgtggaccctaacacgtacattgcgtttctgtcgctgctgggacgtaagaaggaattggacgcggatcaccaacgtctggtgagcgtgtcagccggtgttaaactcctcgccgatgaacgcgttcaaatcttccccgaggaagcggcatctatcctcacgccccgcggagtagtgaaaatcggggatagcattcatcacgcccgcctgtacggctggaagaatcaacgtggcgacatccaggttggcatgttgcgcgttttcggtgcggaatttccttggttcatgcgcgaaagtggagttaaagatattctgcgtgtccctatcccgcagggcagccaatcgtaccgcgatctcgccgccacgactcgcaagttcatcgaaaatggccaagccactgaattcggttggatcacgcagaatgacgaaatcgaaatcagtgccgaggagtacctggccactgataaaggggacatcttaagcgacttcttaggcattctgccggagattcgttggaaagtcacgggcattgaggacaaccgtcgcatccgccttcgcccgctgctgttgtcatctgaggcaatccctaacatgcttaatggccgccttttaacgcaggaagaacatgacctgattgcgctggtgatcaacaagggagttcgcgttgtagtgtcaacttttctggccctgccttcaactaagattattcgtcgtaataacctgggaatcccgcgctggcgtggcaacggccatttaccaacctcgctcgacatccaacgtgcggcaacccaagcattagagggtcgtgac

SEQ ID NO: 5580 - DNA, 3402 bp, synthetic construct
  misc_feature 1..3402: note = Description of Artificial Sequence: Syntheticpolynucleotide
  misc_feature 1..3402: note = MG3-4 sequence codon optimized for E. coli
  source 1..3402: mol_type = other DNA
atgagcactgacccaaagaattaccgcattggcgtggacgtgggcgatcgttcggtcggactggcggccattgagttcgacgacgccggctttccgattcaaaagctggcacttgttacgtttcgtcacgatggcgggctggatcctaccaagaacaaaacgccggtaagtcgcaagaagacgcgtggcgacgcccgccgcactatgcgtatgaatcgccgtcgcaaacaacgccttcgtgatctggacatgatgttgaccaacttagggtatacagtacccgagggaccggaaccggaaacatacgaagcctggaccagtcgcgctcttcttgcatcgatcaaattagccaatgtggacgaattaaacgaacatctcgtccgtgcggtacgtcacatggcccgccatcgcggctgggccaacccttggtggtcgatcgaccgtttagagaatgcgtcccgcgagcctagcgaaacgttcgaaatcatcttggcgcgcgcccgcgaacttttcggagaaaaggtaccagcagaccctaccctggggatgttaggcgccctggcggcgaacaacgaagtcctgctccgccctcgtgacggcaagaagaagaaaaccggctacgttcgcggcacgccgttattagttgccaaagttcgccaagaagatcaactcgcagaactgcgccgtatctgcgaaatccaaggcatcgagggacaatacgatgcgttgcgttcggcgatcttcactcacaaaatggcgtacgtgccaaccgaacgcgtgggcaaagacccgctcaaccccagcaagaatcgtaccatccgtgccagcttggaatttcaagaatttcgtatcttagacagcgtagcaaaccttcgcgtccgcacggactcacgcagtaaacgcgaactgacggaagcagaatatgacgttgcggtggaattcttaatgtcctatacggcgaacgaacaaccttcatgggcggacgtggccgaagttatcggggtcccggggaatcgcttaatcgccccagtgttagaagatgtgcaacaaaagactgctccgtttgatcgcagctccgcggcgtttgaaaaggcaatgggcaagaaaacagaagcccgccaatggtgggagagcaccgacgatgaccaactgcgcagcttgtttattagtttcctcgtggacgcgaccgacgacaccgaggaagcggccgctgaggcgggcttacctgagctttacatgagttggccagcggaagagcgtgaggttctgagtgacatcgacttcgagaaaggccgcgtggcctactcccaagaaacgttgtcgaaattatcggaatatatgcacgaatatcgtgtgggcttacacgaggcacgcaaagcagttttcggagtagatgacacatggcgcccgcccctggacaaactcgacgaacaaacaggacaacctaccgtggatcgcgtcctcaccatcttacgtcgcttcgtcctggattgcgaacgccaatggggccgcccacgtgccattacggtcgaacacgcgcgcacaggactggttggaccggcacaacgccaagaaatcctgaacgagcaaaagaagaatcgcgaaaacaacgaactgattcgtggcgatctccgcaaaagcggcgtcgagaacccaagccgtgccgaggtacgccgccacctgatcgttcaagaacaagaaagccaatgcctgtattgtggggccgttattcgcaccgacacctctgaacttgaccacatcgtcccccgcgcgggcggtggcagtagtcgccgcgaaaacatggcagcagtatgtcactactgcaactctaagaagaaacgcaccttgttttacgactgggccgggccggtcaaactgcaagaaacagtggatcgcgtccgtcaattagaagcgttcaaagactccaagaaagcaaagatgtttaagaaccaaatccgccgcctcaaacaaaccgaagcagacgtacccatcgacgaacgcagcttggcgagcaccagttacgctgcggttgcagtccgcgaacgcctggaacaacatttcaacgaaggcctggccccagacgacaaatcacgcgttgttctcgatgtgtacgcgggcgcggttacccgtgaaagtcgccgtgcaggcggcattgacgaacgcatcctgcttcgtggggaacgcgacaagaatcgcttcgacgtccgtcatcacgctatcgacgcggcggtaatgacgctgttgaaccgctcagtggcgctgacccttgaacaacgctcccaattacgccgcgctttctacgaacttgaacttgacaagctcgatcgcgaccaactcaaacccggtgaggactggcgcaatttcacgggattgtatgaagcctcacaaaacaaatttagcgaatggaagaaggcggcaaccgtgttaggggacttattagcagaggccatcgaagacgacgcgatcgcagttgtttctccgttgcgcttacgcccccaaaacggtagcgtccatgacgataccatcaacgcagtcaagaaattaaccctgggctcagcgtggccggcggacgcggttaaacgcatcgtagacccagaaatctatctcgccatgaaagatgttcttggcaagctgaaagaattgccggaagactcagcacgtagtttagaactttctgacggtcgttatatcgaagcggacgacgaagtgttgttctttccaaagaaagccgccagcatcctgaccccgcgcggtgccgcggaaatcggcaacagtatccaccacgcccgtctttacagctggcttactaagaaaggagagttgaaatttggcatgctgcgcgtttacggggctgaatttccttggttgatgcgcgagagtggcagtcgcgacgtgcttcacatgccgatccaccctgggagccaaagttttcgtggtatgcaagacggggttcgtaaagctgtggaatcgggtgaggccgtcgaattcggttggatcacccaagacgacgaactcgaattcgacccagaggattatatcgcccatggcggcgacgacgaacttaaccgcttactgcgcgtcatgccagaacgtcgctggcgcgttgacggattttacaacgcaggcacactgcgcatccgtcctgccctgcttagtgcagaacaactgcccagcgaactgcaaaagaaagtggccgacaaaacactgtcagatgtggaactgatcctgctgcgtgcggtgcaacgtggactgttcgtggccatttcaagtttcctgccattagaaagcttgaaagtaatccgtcgtaacaatcttggctttccgcgctggcgcggcaatggaaacttgccaaccagctttgaagtgcgcagcagcgcacttcgtgcgttgggcgttgagggg

SEQ ID NO: 5581 - DNA, 3009 bp, synthetic construct
  misc_feature 1..3009: note = Description of Artificial Sequence: Syntheticpolynucleotide
  misc_feature 1..3009: note = MG14-1 sequence codon optimized for E. coli
  source 1..3009: mol_type = other DNA
atggaaattacaattaaccgtgagatcggcaaattaggcttgcctcgccacctggttctgggtatggacccgggcatcgcctcatgtgggtttgccctgattgatacggctaaccacgagattctcgaccttggagtgcgcctcttcgattcgccgacccacccgaagaccggacagtctctggcagtcatccgtcgtggatttcgttcgacacgccgtaatatcgatcgcactcaagcccgtctgaaacattgcctgcaggttctgaaagcctacgggctgattccgcaggatgctacgaaggaatattttcatacaactaagggtgataaacaacctttgaaactgcgtgtagacggactggatcgtcttttgaatgaccgtgaatgggccctcgttctgtatagcctgtgtaaacgtcgcgggtatattccacatggcgaggggaaccaagacaagtcgtctgagggtggtaaagtgttgtcggcgctggccgctaataaagaggcgatcgccgaaacatcctgtcgtacggtgggtgagtggctggcccaacaaccgcagtcccgtaaccgcggtggaaactatgataaatacgttacccatgcacaactgattgaggagacccacattctgttcgacgcgcagcgttcattcggatctaagtatgcgtcccctgagttcgaagcagcctacattgaagtgtgtgactgggaacgcagccgtaaggattttgatcgtcgtacttatgatctggtaggtcattgtagctactttccgaccgagaagcgtgcagcgcgttgtaccctgacttccgagcttgtgagcgcttacggtgcgctgggtaatattactattattcatgagaatggcacatcacgtgctttatcggcgaccgaacgtgacgagtgtatcgcgattttattttcttgtgaaccgatccgcgggaataaggactgcgcggtaaagtttggtgcactgcgcaaggccctggatctgtcaagtggagactatttcaaaggcgtgccggcggcggatgagaagacccgtgaagtatataaaccgaaagggtggcgtgtcttacgtaacacacttaacgccgcgaatccgatcctgttacaacgccttcgtgacgatcgtgaccttgcggacgcggtaatggaagcagttgcgtactctagcgcactgccggtcttgcaggaacaattgcaaggactgccccttagcgaggcagaaattgaagcactgtgtcgcttaccgtacagcagcaaggccttaaatgggtacggtaatcgcagcaagaaggctttagatatgttactggactgtctggaagaaccagaagttctgaatttaacccaagcagagaacgattgtggcctcttaggtttacgtattgccggtgcgcaattagaacgttcagaccgtttaatgccgtacgaaacgtggattgagcgcactggccgcaccaacaataacccagtggtgatccgtagcatgtcacagatgcgcaaggtagttaatgctatttgtcgtaaatggggagtaccgaatgagattcatgtggaattggaccgcgaactgcgtctgccacagcgtgcgaaggatgaaatcgcaaaagcgaacaagaagaacgaaaagaaccgtgaacgtatcgcaggccagattgcagagttacgcggatgtacagctgacgaagtgaccgggaagcaaatcgagaaatatcgtttatgggaagaacaagagtattttgacttgtatacaggtgccaagattgaggttgaccgtctgatctccgatgatacgtatacccaaattgatcatattttgccattttcgcgtactggcgagaatagtcgtaataataaggtgttagtgctggctaagtcaaaccaagacaagcgtgagcaaaccccgtatgagtggatgtctcatgatggggccccgagctgggacgcgttcgaacgccgtgtgcaagagaatcaaaagctgagtcgccgtaagaagaattttctgttggagaaggatctcgacacgaaagagggagagtttctggcgcgttcttttacggatacagcatacatgagtcgcgaggtgtgtgcctatttagcagattgcttattgtttccggacgacggtgcgaaagctcacgtcgtgccgacaaccggtcgtgctacggcgtggttacgccgtcgttggggtctgaatttcggctctaacggtgagaaggatcgttctgatgaccgccatcacgcaacagacgcgtgcgttatcgctgcctgcagcccgtcgctggttatcaagacggcgcgcattaatcaggaaactcattggagtattacgcgcggaatgaatgaaactcagcgtcgtgacgctattatgaaagccctggagagcgtgatgccgtgggagacattcgccaatgaggtccgtgccgcccatgactttgttgttcctacccgtttcgtgccacgtaaaggcaaaggtgaactctttgaacaaacagtgtaccgttacgcgggtgtgaacgcgcaaggtaaggatattgcgcgtaaagcgtcgagtgacaaagatattgtgatgggtaatgcggtagtatcagccgatgagaaaagcgtgattaaagtttccgaaatgctttgtttacgcctgtggcacgatcccgaagcgaagaaaggtcaaggggcgtggtatgccgatccagtgtacaaagcagacatcccggccttgaaagacggcacctacgtaccgcgcatcgcaaaagcacacaccggtcgcaaggcgtggaagccggttccggagagcgcaatggcgaaaccgcctttagagatttatttcggcgaccttgtacagattggtgactttattgggcgcttctctggttataatattaacaacgcgaattggtcattcaccgatcgcctgactcgccttaatttgtcatgtccgacggtgggccagctgaataatgatctgagtccggtcgtgattcgtgagagcccgattaag

SEQ ID NO: 5582 - DNA, 3246 bp, synthetic construct
  misc_feature 1..3246: note = Description of Artificial Sequence: Syntheticpolynucleotide
  misc_feature 1..3246: note = MG15-1 sequence codon optimized for E. coli
  source 1..3246: mol_type = other DNA
atgaactatgtgctcggcctggacgtcggtattgcttcagtgggatgggccgtgcttgagttgaatgaagaggacaaccccattcgcattgagggtcttggtgcgcgcatcttcgataaagcggaagtgcccaaaaccggggccagtctcgccgcacctcgtcgcatgagtcgtggcatccgtcgcgtgattcgtcgtcgccgctttcgcttacaacgcgtccgctcatacctgaagaagcacaacattctccctgccgagaaggttgatcacttatacgacgttccatctgccatcgacatctacgagctccgtaagcgcgcactgactgagaaggtcacagccgaggagtgggcgcgcctgttaatcttcttcgcgaaacaccgtggtttcaagtccaaccgcaagaaggcttcgggagacgccgacgagggcgagatgctcaaggcgatcgcagcaaacgccgaaatcctgaagaactatcgtacagtgggagagatgctgtgcgacaacgagaagtttcgtaaacgtaagcgtaatcgcgatggcgcatacaactttactgtctctcgtgcgatgctgatggaagaaattcacacgctgttcgagattcaacgcaacttgggccagaagttcgcggacgagaagctggaagaggagtacgtgatcctcttcgccgctcaacgtaaattcgatgaaggacctggagaaaattcgccgtacgcggggaaccagattgagaagatgatcggttcctgcacgttagagggcaagaaagagaagcgtgctccaaaggcctcatacgcatttatggcatttaatttatggcaaaagatcaatcacttgaaagtcaatcgtcgtggtagtgaacgcttcctgaccgaagaggagcgccgccgcattgcggacctggcgtggaagaaggagaagcttacctacggttcactgcgtaaggtgctctcgttggaccccgaggatcgcttcgttggcctgcgttacgacctcaagaaaggcaaggccgagaacttagaagaacccgtttctgaggcagaaaagcgttccttttcatgggtcaaggattatcactccattcgtaaggcccttgacaaggtggagaagaatcgcattttgaagctctctcacgagcaactggacacaattgccaccgcgtttagtgtttacaagaacgaagagaccattgaaaagtacctggaagagggcggcattggtaaggccgacggtgaggcgctgcttgagcgtttgagcggatttagcaagtttggtcacctgagcctgaaggcgtgttataagctgctgccgttcctggagaagggcgaggtgtactcacgcgcttgtgagttggcggggtacgactttagtaaatcgtccttggagaacattgacgacattccgaacccggtcgtaaagcgctcgatttctcagacccttaaggtgattaacgcgatcattctgcgctacggcaacccagttgaggttcacattgagttagcacgtgagctcgcccgttcttttcgcgaccgcaagaagatggagaagggtatgcaagagaaccaagcgaagaacgagaaaattcgtcagcgcctgattagtgagttcggggtgctgcgcccaaaaggcatggacattgttaagttcaaattatgtgaggaacaaaacggggagtgtgcctactcgcaaaagcactttgacatggaaaagttacttaaggacccgagttacgccgaggttgaccacattatcccgtactcacgctcattcgacgacagttataacaacaaggtgctggttctgacgaaggagaatcgtgagaaacgtaatcgtatcccgatggagtacctcgccgacgcgcctgagcgcaagaaccgtttcattcactgggtcaaatccacaatccgcaatagtcgcaaacgtgagaatcttctgcgtaccgattacacggcgactaccgagaatgagtggaagcgccgtaacctgcaggacactcaatacatttcgaaatatttatataactacctgcgccatcacctggtccttgcgaaaggttacacagagcgtaagcgtcgcatcattccggttaacggtgctgtaaccgcatactttcgcaaacgcctgggtattaacaagattcgtgagaatggcgacctgcatcacgcggtggacgccgttattattgcgtgtgccacacagggaatcgtcaacaaagtttcccgctatagtaaatcgcgcgaactctgggactacgaggtcgacatggagacgggtgaggtgctgcagaagaagaacaagaataccaaggatgtctttccggagccgtggcttaactttcgttacgagttggagcagaaggttcgtgtgcgccccttggacattcccgagacggcagacatcacggagatggaagagccgttcgttagtcatatgcctaaccgtaagatccacggtcctgcccacaaagagactatccgctctggccgccttaaagaggaaggttacacaatcagcaagaccgctctcatcgacttaaagcttactgaggacaaggaagagattaagggctattataacaaggagtcggaccgccttttgtacgaggctttaaagaagcagctgcagcgctacggtggcaaagctaaggaagcgttcaaggagccgtttcacaagcctaaagcagatggtaccccgggcccaatcgttaacaaggtaaagatcatggagaagagcactatgttaatcccggtgaacggcgggaagggtctcgcgtcaaacggcaacatggttcgcatcgacgtctttcgcgccgaggagaaaggtaagaagaaatattacttcatcccggtttatgttgctgacactgttaaggaagagcttccgaaccgtgcggtcttggcccacaaaccatacgaagcctggaaaattatgaaggaagaaaacttcatcttctccctctacccgaacgaccttatcttcgtcgacgccggtaaggaaatcccgttcaaagccgcactgaagggtagcacccttgacccggaaaagaaagcatcgcgtttcctgatgtactacaaaggggccgacatcgctaccggtagtattagtggcgtgaaccacgacgaaacctacaaagcacgcggcgtaggtattcagtcactgcgcgagattaagaaatgttgcattgacgtgctgggcaacatcagcttcgcttccaaagagaagcgccaaacgttccgt

SEQ ID NO: 5583 - DNA, 3681 bp, synthetic construct
  misc_feature 1..3681: note = Description of Artificial Sequence: Syntheticpolynucleotide
  misc_feature 1..3681: note = MG16-2 sequence codon optimized for E. coli
  source 1..3681: mol_type = other DNA
atgaagcgtatcctggggctggatctgggcacaaatagcatcggctgggctctggtggaagtggacgaggacggtaagattatcaagatccttggcatcggttcccgtatcatcccgttgagcccggatgacgcgaacgaattcacgacgggcaagagcatcacgaagaatcgcaagcgcaccgagcaacgcaccacgcgcaagtgtttcgaccgttaccagctccgccgcctgttgttaaccatcgaacttcgtaagtttaacatgctcccggacgaacgcttaattaagctgccggtcctggacctttggcagctgcgcgcaaaagccgcgacaaagggtaaccgtctgaccctgccggagctgggccgcgtcctgtaccatctgaaccagaagcgtggctacaagcacgcgaagagcgacgagtctaacgacaagaatcagcgcgagtacgtggccaacgtcaacacgcgctacgccaacattaaacaactgggtaagaccattggccagttcttcgccgagaagcttgaagagaaccaggtgattactgagaagggcaagttctacacctaccgtatcaaggaccaggtatttccccgcaaagcgtacgaagaggagttcgaccagattatggaatgtcagcgcgagttctaccccgaaattctgaccgacaagtttattgacaaggtgcgtaacgagatcatttactaccagcgtaagcttaaaagctgcaaacaccttgtgagcctttgcgagttcgagaagcgcgcgtacgtcaacaaagacggcaaggtagtgtacgacggtccaaaggtagcaccgcgcacctcgcctctcttccaggtgtgcaaaatctgggaaagcgtgaacaacttgaagattaagaaccgcaagaacgacgagctgtacattacccaagagcagcgcattgcgatgtttaatttccttaacaataacgagaaaatgacccttagcgacatgtacaagatcttgaagatcgataagagcgatggctggtggggcggaaaagcgattggtaacggcctgcaaggtaacaccacgaagatgcagttaaagaaggccctgtcgaactgccagaacgttgacgagctgcttcagttcaacttggacatcgtggactcagataagattgacgaggagaccggcgaggtgctgaaggtagtgtctcctaactgtgagcaggagccactgtacaagctgtggcacacaatctacagtatccaggacaagaacgagctgaagaacgtcttacagaagaagtggggtatcacggacgagaccaccttaaacagcctcttcgcgctggacttcgtgcgccccggctacggtaacaagtcgagtaagttcattcgcaagattctcccttacttacaagacggtctgatgtacaacgaggcgtgcgcttatatcggcgtcaaccacagtaactcgctgacgaaggcggagaacgacgcgcgtgagctgctggagaagctgccgcaaatcaagaagaatgagctgcgccagccggtcgtagagaaaatcctgaaccaaatgatcaacgtggtaaacgcgattttcgacaagtacgggaacaacaacggaatcgacgagattcgtgtggagctggcacgcgagttgaagcagagccgcgaggagcgcgagctcaccgacaagaacaaccgcaaccgtcagaaggagaacgattcgaacgcgaaactgattgaagagtacggcatccgcgcatcccgcaaccgtatccagaagtaccgtatgtggaaagaaagccgccagacctgcttttactgcggccaggtcgtggacgtgaaggacttcttgcgcggttacgacgttgaagtggagcacatcatcccgaaagctctgttcttcgacgactcgttcagcaacaaagtgtgcagttgtcgcaagtgcaacagcgaaaagggtgagcgtaccgcgtacgactacatgagctcaaagggagaggacgagctgaaccgctatatccgtacagtcgaggatcgttgcaagaagggcgaaatctcgaagacaaaacgtgagcgtctgttaacgccggccgacaagattccaacggacttcatcaatcgccagcttcgtgagacccagtacatcgcgaagaagagcgttgagatcctgaagcagatctgccgcaacgtttggaccacctctggtagtgtgacagacttcttacgtcacaactggggttatgacgaaatcttgcacactctggacttcgatcgctacaagagcggtggcctgaccgaggtaatcgaaatcgagcacaagggccagaagcaccgcattgagcgcatcaaggactggagcaagcgtctggaccaccgccaccacgcggtggacgcccttgtggttgcctgcaccaagcagagctatatccagcgcctgaataacctcaacaccgagcgcgacgccatgtaccaagacatcgaggcgcagagcgtcgagtggaaggagaagcacagcttgctcgagaaatggatcaagttacagccgcacccgacggtgagcgaagtcacagacaaggttgacgagatcttggtatccttcaaagcaggcaagcgcgtagccactctgggtaagcgcagcgtttacaagaacggcaagaaaaccgtggtgcagaacaacattatcgttccgcgcggggcactctgcgaggagtcagtatacggccagatcaaccttatcgagaagaacaagccgattaagtatttgttcgagaacccgagcctgatcttcaagccgtacatcaaggccctggtcgaggaacgcttaaaggagtacaatggagacacgtcgaaggccatcagcagtctcaagaacaatccgatttaccttcgcaaagacaaatcagtagtgcttgagtacggtacctgttataagaaggagtacgtaaagaagtactcgctgaactccattaaagctaaggacgtggacagcatcatcgataagcacatccgcgaagtggtccgtcagcgtctcgaggataacaataacaacgagaaggccgccttcgcgagcccgctgtacgcggataagcagaagcagatcccgatcaagagcgttcgctgtaccactggcatcaacatcgccgcccccgtaaactacaacgagtctaacgatccgatttctttcgtgaaaccgggcaacaaccaccacatcgccatctacaaagacaaagacggcaagcgtcaggaacacattgttaccttctggcacgcggtggagcgcaagaagtacggcatgcccgtagtcatcaccaaccccaaggagatttgggacctcatcatcgagaaaagcttggacttgccggagagtttcttaaactgcctgccgaacagcgactggaactacgagatctccatgcagcagaacgagatgttcgtgatgggcatgagcgaagacgagtttcaagacgccatccgcaataacgactacaagacccttaataagtacctgtaccgtgttcaatcggtcagtgagagcgactactggctccgtctccatatcgagaccatgaacgacaagacgcctgagggtaacatcatcaagaagtactaccgcattaagtcaattaacaccttcttcaacttcaacccgcacaaggttaaaattaccttgctgggtgagatccagagtagt

SEQ ID NO: 5584 - DNA, 4044 bp, synthetic construct
  misc_feature 1..4044: note = Description of Artificial Sequence: Syntheticpolynucleotide
  misc_feature 1..4044: note = MG18-1 sequence codon optimized for E. coli
  source 1..4044: mol_type = other DNA
atggaccagagtaaagagtactacattggtctggatggtggtacggactcggtcggatgggcggtactcaacccggactataccgtcgtgaagaagcgtggtaaaagcctttggggcgtacgcttattcgagagtgggcagacggcggcggagcgtcgtttagcccgttcggcgcgtcgtcgtacggatcgcaagaagtggcgtctgaaacttttaaaggaactgttcgcggaagaggtggctgcgtgcgatcccgcgttcttcgcccgtctggcagagtcccgttactgggaagatgacaagaaagttgatggtgcggatactttattccatgacgcggacttcaccgacaaggattaccatcgtcaattcccgacgatttaccacctgcgccgtcatttaatgtgttgtactgagaaaccagacattcgtctcttgtaccttgccgttgcccatatgattaagaaccgtggtcacttcttgaatgagggccaagacttgaaccaagtccgtcgtttcgatgacgtatggcagaatctttgtgcggctgtatcggacgttttagggatcgagttagccgtcgagaatggcgcgaaggccgctgaagtattaaccagcagcgttaaaattaaggaaaagacgaaacaattggaatcagtactgggcgagggtgagtcggaagcggatcgtagtgtttgtaaagccctggctggtttacttgcgggtgcgaaagtttcagccgtagacttattcaatggtgatgaggcattgaaagaatgtggaaagttttcactggcggagaagtcgatcgaggagctcgaacccgacctgggtgacgccttgggcgaggaacgtttcagccttttacaatacgcctacgcggcttataattgggccgtgttcgctcgtctcctgccagaaggcaagacaatttctgaggttaagacagaagagtatgaggcgtataaagcggaccttcgcgcattaaaacaattagtgaagcagtacgccagcgaccagtactatcgcgtctttcgtagcgcaaagattaaaggaaattatgccagctacgtaggtaagaccaactgtggaaatgagaagtcgaacccggagtcgtgtaaaccagaggagttcttcgcgttcctcaagaaggaattaaaaccactgtggtcccagaatatccccgccgccgcgtcactggctgcgaaattagagagcggcactttactccgtcgtcaacgctccggtgaaaatgcggccattccgtaccaagcccaccttcaagaattacaaattatcttaaagaacatgcaacaattttacccattcctgcagaaggcggacgagaatggtttcacccctgcatacaagatcgagaaactcttgacgtttcgtatcccttactacgttggtccgttaaacgacgcacataaagagaagggattctgttggatcgtcaagaaagcggacgttccagtgctgccctggaacttcgaccaagttgtcgatgagaatgcatgtgaggacgctttcattggccgtatgtctgcgacgtgtacttacttagtcggtgaaaacgtacttccccaaaactcgccactctattgtcgcttcatggtcttaaatgaattaaacaacttacgtatccgttcagagaaaattacgccggctttgaaacaggccatctttacacaattattttgtgctgggaagggtggtaaagttactcaaaagaagctcttggacttcttacacagccaaggtatcgacgcgaataaacaagacatttcgggtatcgatggtgacttcaaggcgtcgatggcgccagcagtgaaacttcagtctatctttactgaaccgttgccgcctgagatcctcgagcgtttagcatttgcacttaccgtgtcaggagagtctcacaaaatgttgcagaatcgtatccgtgccatccttcctaacgcggataacgcggtcattcgtaaggtgtgtgcgctcaagtttacaggatggggacgtttatcgcagaaacttctgactgaaatctacgacgtcgatcagactacaggggagtgtcgctccctcatggacttgctttggagtaccaataataaccttatgcaacttttatcaggcgacttcaccttcgcagcgggtattgacgcgtacaacgcggctcagaatggtaccgagaatatcttcgactacgatcacttggttaaggacttgtacgtctcaccgtcagtcaaacgtggtctgtggcagaccctgctgctggtcaaagaggtccgtaagattatgggttgcgatccggcccgtgtgttcattgaaatggcacgtggagtaagccctgaacagaagaataagcgtactgtaagccgtaaagaccaattactggccctctacaaggcatgtaaggaagacgcacgtgattggtgtggtgaattagaagcgttaccagaagataaattgcgttcggataaactttacctctactatacacaaatgggacgttgcatgtattcgggagagccaatccgtttagatgatctgatgcatgatacggcaaaccaactttacgatattgatcacatctaccctcaatccaagactaaagacgattcgctcactaatcgcgttcttgttaaacgtcaattgaatgcaatcaagtcgaatgactaccctttaccccagactatgcgccagaccgctctgtggaaggcactgctggagaagggcctcatttcaaaacagaaatacttacgtttgacacgtacgactcccttcactgaggaagagttggctggtttcattaatcgtcaattggtagagacccgtcaaagcactaaagcggccgcgcacttattggaacaattgctcccaaatacggaagtggtatacgtgaaagctggcttggccgccgactttcgtcaagagtttggcttcgttaaatgtcgtgacgcgaacgattttcatcatgcaaaagacgcatacttgaatgcggtcgtcgggaacgtctatcatgaaaagttcacgaagaacccattgcgcttcgttcgtagtggccaagagtattccttaaacttaagcgccttatttcagaattggaatatctacaaaggcggccgtgttatttggcagaaaggagaggatggtagcctggagactgtacgcgcccgtatggcgaagaatgatccaatggtcactcgttactgtacagaaggccgtggagcgctgtatgatttgcaaccgatgaagaagagtaaaggtcaactgcctcttaagtcgtcagacgagcgtttgcaacacattgatcgttatggcgggtacaataagctggctggcgcgtatttcacgttagcggcatactataagaagggtaaacgtgttaagtcaatcgagtcggtacccttatacctcgcggcaaaattgcaacgtgaccccgccgcactccaacaataccttgcagatcagctcggaacggatcgcgttgagatcctcgtacccgaaattaaactgggtactttatttaaatggaatgggtacccaatgacgttatcgggccgcacgggaccccagctgttatttcgtaacgcggccgagttacgtactaatgcagaacaagagcaatatattaagaagatgagtcgctacctggagaagtgtaaggggcgtaaagaacctcttccgattcgtccggcatacgataagttaacccccgaagagaatttacaattatatgacgcctttacacagtggttgactagtggaatttacgcgaagcgtctgagtttgcaagggaagtttcttcttgaaaagcgtgacgcgttcgccgcactgtcgccggaagcgcaagtccgccaattaatggaaattcttcacctgtttcaatgtaatccggtcgcagctaacctgtcggaactcggtggggctgcccatgcggggatcctgttggcaagcaagaacatcgatggtaaagtcccggtatcgattgttcaccagagcgtgactggttatttcactcaagaggtgtgtttaaatgatctg

SEQ ID NO: 5585 - DNA, 3294 bp, synthetic construct
  misc_feature 1..3294: note = Description of Artificial Sequence: Syntheticpolynucleotide
  misc_feature 1..3294: note = MG21-1 sequence codon optimized for E. coli
  source 1..3294: mol_type = other DNA
atgaccagtcacagcatccgttatacccttggtttggacatcggaatcgcgagcgtgggatgggccgtccttcgcaacgggagcgactccgaaccttaccgtatcgaaacccttggtgtgcgtatctttgataaggctgaagtaccgaaaactggcgcaagccttgccgcccctcgtcgtgaggcccgttcatcccgtcgcgtagtccgtcgtcgtcgccatcgcaaggaacgcattaaatacctgatcgaacaagagggcattatgacccaggccgagatgacccgcttgttccagaacagctcgttcgagaagagcgtgtacgagattcgcgtagaggccctggaccgcatgctgacccgtgaagagacggtgcgtctcctcatccatttcgcgcaacgccgtgggtacaagagtaattcgaaggcagaagaggcgaaggacaatgaaaatggtgtgattaaacaggcaattagccaaaacaaacaggcaatgaaggcccacggttatcgtaccttcggagaaatgttattgatggacgagcgcttttactatacccaaccagatggttctcgtatctttatcccgcataacaaggcgagtgattataaggtgactgcggaacgtagtatgttggccgacgagttacacatgatcttcgctgcgcaacgtagtctcggttccctctggttcagcgacaccttcgagacagcatacatggacgtgtggagctcccaacgttccttcgatgagggcccaggcggcgactcaccgtatggtggctcgcagattgagaaaatgttagggacctctagcgacggcgagagccgcgcccctaaagccagctacagcgcggaatacttccgcctgctccaggatgtgaaccatctccgtatcgtgagcttagacggtacctcaagtcctctgacccaagagcaacgcgacattgtagtggctgcgagtaagaagagtggtaccttgacatacacccaattacgcaagaagctggctctcgcagatgaccaatactttaacgccctgtactacggcgataaaactgcagtcgaggtggagaagaagcgttttggtcatctgcagttctaccaccaactgcgtaccgcccttgacaccgtcgagaagggcgctgccgacacgctgacgtgggcccaacgcgacgaaatcgcacgcatcctgacagtttacaaggcggacgttcgtcgcaccgacgagttacgtaaagccggtatcccggcggagtacatccgcgccctgctcccattatcgccgacccgtgcgatgcacctgagtgtgacagctattcgcaagatgatccctcacttagaagccggtatgtcgtatagcgacgcctattccaaggcctatggcaaccaatcgacggcgtccgcagccccgaagaagaacaaactctcactgaacgatatcgaagagatcaccaacccggtagtacgtcgcgcggtcagccaatcgattaaagtgattaacgctatcgttcgtcagtatggcgcaccagagcgcgtgcgcatcgaattggcgcgtgagatgggtaagaattttaaggatcgtggcaaaatcgcaaagagtcaggccgaccacgcggctaagaatgagcgcatcaaagcccaaatctcagagtacaagagtgatcatattacgggccaagacattgttaagtttaaattgttcaaggaacaagatggcatttgcttatattcgggcaagtcgcttgatatcgcccgtcttttcgagccggggtacgtggacgtggatcatatcatcccgtactctatcagcttcgacgattcatacaataataaagttttggttttaagtagcgagaatcgccagaaaggcaaccgcatcccgtacgcatactttggccagaatagcgaccgttgggagaagtatgagacgcttgtatcaaataccgtccgcagttatcgtaaacgcaagaatttgcttctgaaaagccttagtgaagcccaaatcgacggttttaaacagcgtaacctgcaagacacccagtatctcagtaaagtaatctttcgccttattgaaaatcatctccaattcgcagagaccgctccgggcaagaagcacacgcaacccgttaacggtgcgattaccgcgcaagtgcgtaaacgtttgggcatcgaaaagattcgcgaagatggtgacttacaccacgcagtagacgcggccgtcatcgcgtgcatcaccccgggcatgattcaaaagatcaccaagtacgcgcagaaccatgaacgcttttacgccactgccaagggttacgttgatatcgagactggtgaggtgctgacccgtagtgaatacgaagcgatggacgacattcgcttcccggagccatggccggggtttcgcagcgagctggaagctcgcgtgagtgaacacccacaagaggcgatcgcgcgcctgaaattgccccattacgagaatagcgaagaaattcgccccattttcgtgtcgcgcatgccgaaccacaaggtcaccggcgcagcacacttggagactatccgtagtaagaaaggtggagcaggctctaccgtaactaagaccgccttgccggacctcaagttggataagaatggcgagatcgcaggctactatcgcaaggaagacgatccgttactgtatgaggctctcaaagcccgcttgaaagcgttcggcggagacggcaagaaggccttcgccgaaccttttcacaagccgaaacataacggtgagccgggccctatcgttaagaaagtcaagatccaagagtccgcgacgctgaccgtacccgtcaaccatggtatcgccgcgaacggctccatggtccgcttagacgtgtttcacgtcgatggtgacggctattacttcgttcccatctacacttcggacaccgtgaaacccgaattaccgaaccgcgcggtcgtcgcggggcgccgtgtccaagaatggaaagtgatggacgatagttactttaaatttagtttatacccgaaggatttaatccgtattcgcagtaagaagggtatcaaactcaaagcggtgaatcgcaacgccgaccttcaagaatacagcactaacgattgtctgtgttattttgtcaagttcaatatctctactggcgcgctgagcgtagagaatcacgaccgtaagttcgaacagcccggattgggtggtaaaaccctcttatcaattgagaagtaccaagtagacgtattaggaaattacagcccggtagccttaccagagaaacgcatgaaatttcgc

SEQ ID NO: 5586 - DNA, 4563 bp, synthetic construct
  misc_feature 1..4563: note = Description of Artificial Sequence: Syntheticpolynucleotide
  misc_feature 1..4563: note = MG22-1 sequence codon optimized for E. coli
  source 1..4563: mol_type = other DNA
atgacgaagaatactcgtaatattatcggtctggatctgggcacgaactccatcggttggtcatggatccagcaactcattagcccgacaccgacccagccatcggagtacttgttcgatggcacccccatcatccgcatgagtggttcccgtatcatccctatgccgggtgacgtgaccgggtcattcgaacgtggagagactattagcaaaacgaaggatcgtactgccaaacgtatggcccgtcgtatgaatgagcgtttccagcttcgtcgcgagcgcttgaatcgtgtattaaacatcatggggttccttccggaacattacgctcgtgccctggatcgttatggtaagctgaatgaggagtctaatactactattgcctggcgttcgaaagaggatggtaagaacgagtttatcttttaccctagcttcttggagatggcctcgatcttcaaagaacatcatccggacattcagcgtatcccccttgattggacgttgtactacctgcgttctaaggcgttgcatcaggcgattactaaagaagagctctcctgggtcttgcactcatttaaccaaaagcgtgggtattaccagagccgtgaggatattacggaagaggataagaccaagaaagtggaatatattaagggcgtggtgaatagcgtcgaggatacgggcgagaaggccaagggtaagaagatctacaaggttacatttgcggacggaaccgaattcacctcgacgaaaagcgaggcaccactgtggatcggtcgtacgcgcgagattatcgttaccactagcctggatacttcaggcaagccgaagttagataaagagggtaagattatccaatctgcgaagaccccggacgaaaaggattggacgcttattaaaattcgtactgaggcaacgattgacgattctaagttgactgttggcgagtatatcttccatgcgctcctgaagaatccggaaacgaagattaagggcgcgcatgtttctacaattgatcgccgtttctatattaatgagattaatgcgattttgaaggaacaggagaagtatcacgaggagctgcgcgataaatcactgtatgaacaatgcacacaggcgctttacgcgcagaatgaggtgcgtcgtaatattattgcgccgtggtctatgagcgatcttctgatcaaggatattttattctatcaccgccctctcaagtctaagaaatcacagatcagcgagtgttcgttagaattccacacgtacacggataaggatggcgcgacccatcgtcagggaattaagtgtattccgaccagtcacccactgttccaagagtatcgtatctggcagtttatcgcgaatttacgcatctatgagcgcgaacgcttcgataatggaaaacatttcattaacgaggatcgcacgagcgacttcttaaccacgaagaagaaggaagagctgtacgagtggttagcagaaaaggacagcgttagtcaaaagacgctgcttggccatctgggcttaaaagtggagcgctaccattggaactttccggaagaaaagacttacccgtgcggcgagactcgtcacctcatccaatcacgcatgaagaaggcgaacctgcaaaaggcgtttcacagcctcatctcggacgaacagaaggactgctttgagcgcggcctgtggcacattttatacagtgttagcgattacaatgaactttgtaaagccctgaagaccttcgcgcgtaagaccggctttaccttagaggagcagtcgttgttcgtcgaggcattctcgtcgtgtcccccatttaagaaggattatggcgcatatagtaagcgtgctattacgaagctgctgccactcatgcgtattggcaagttctggcatgaggagagcattgacagtaccaccaaaacacgtatcgagcaccttattagcggcgaagagtgttcaggtattgatgtgcgtgtgcgcgagaaggtgacgaaggcgggtctgtgtgagtctatcgagcagtaccagggccttccgcagtggcttgccaattacgttgtatataatcgccacagtgaggctagcgagattacaaagtgggagtcgccggatgagctggataactatattcgtagctttaaacagtactcgttgcgtaaccccattgtcgaacaagtgagcttagagaccttacgtgttgtccgcgatttatggaccgagctgcagaaggaaggacagactatcgatgagattcacttagagatgggacgtgatctgaagaatacggcggaagagcgcagccgcatcttccgtcgtaatagtgaaaatgaggacacgatcttccgcattaaactgttattagaggaattctatgcgaatgagaaggatatcaaggatgttcgtccgtacagtccgtctcagcaggaattgttgcgtatttatgaggaaggtgtctggcagcaggagaaggacatcccacaggatattaaagatatcaagaagcgcatcagcaatgataaagatatcaaggatattaccccgaatgatattcagcgttatcgcatttggatggaccaaaagtactgctcaccgtatacggggaagaccattccgcttagccgcttgtttacaactgattatgagattgagcatgtaatcccccgcagtcgttacttcgatgatagctacaacaacaaagtgatttgtgaggcggcggttaataaggataagaataatcgtttagggatggagtatattatggccgcgggcggtaagacaatcgagctgggaaatggcaagaatgtgcagatcttaaaagaggaagagtatgtcgagttggtggataagattttcggtagtaatacccgtaaacgtaatattatgttggccgatgagattactgaggaattttctcaccgtcaattaaatgatacgcgttacatcgcacgctttatgaaaggtattttgtcaaatattgttcgtgaaaagaacgctgaggggactctcgagccggaagagacgtcaaagaaccttatcgtatgcagcggacgcattacggatcgtgtgaaacaggattggggcttgaatgatatctggaatcacattattaccccacgcttcgagcgcttaaataagaaaactagcagcaatgacttcggtgagtatgtatgtaaagagggaaagcgctactttcagacccgcgtaccgctgaaccttcagaaaggttttaataagaaacgtattgatcaccgtcatcatgcgatggacgcaatcgcaatcgcatgtattaaccgttcaattgtgaattatcttaataacgcagctgcgaatcagactgagcgtgaggatctgcgtcgcgcggtatgtatcccggagcgcaatggtcaaacgaagcgtcagctgcgcagtccgtggcactgcttcgcgcgcgatgccgagaatgcattgcgccagattgtcgtatctttcaaacaaaacttacgtgtggctacgaaggcaactaatagctatgagtgcttcgatacggccagcggaaagaagattcgcaagcatcaatcaaatcgcgagcattatgcgatccgcaagcctctgcataaggacagtgtgtatggcgaggtaattcttacgtcgattgcgagtgtgaacctgaagaaagcgctcctgaaggcggagcgcatcttggataagcgccttaaagaaaagattttcgaacttcgcaagttgtataactacagtaataagcagatcgaagagcacttaaccaaagtatgcattaactgccccgagtggaagaattatgactttaagaaaatcgcagtacgtatcctgagtaatgacgcggacgcaacccatatcgtagcaatccgcaagccactggatgagtcattcgacgaagtgaagattaatacgattactgataccggtattcagaaaatccttctgaatcatttgtcacgctatgcggacgatcccaagaaggcgttcagtcctgagggaattgaggatatgaacgcaaatattgcgtcattgaatggtggcaaacagcacttaccgatttacaaagttcgcgtgtccgagaaggataatggcggatactttccgatcggacagaagggcaaccgcccaaagaagtacgttaccactgcgaaggacacgaatctgttcttcgcagtctacgccgattccaagggtaaacgttcatataaaacgatcgacttacgtaccgctattgagtgtcgcaagcaggggctgagtgtcgcgccttctattaatgagaaaggggataagcttttgtttaccctgagcccgaatgatctggtgtacatgccatcagagggtgaggaagcgaatggcttcgcaattgataataacctgaataaggatcagatttacaaaatggtatccgcgaataataagcagtgtttcttcatcccacatacggttgctgatttcattagtcgcggtgaggagtataactctcacaataaaatcgagttgaccgaggatcgccgtagtattaaggaacactgtgtaccgttgaaggtaaatcgtttgggaaag

SEQ ID NO: 5587 - DNA, 4131 bp, synthetic construct
  misc_feature 1..4131: note = Description of Artificial Sequence: Syntheticpolynucleotide
  misc_feature 1..4131: note = MG23-1 sequence codon optimized for E. coli
  source 1..4131: mol_type = other DNA
atgggcaagaagatgtacgttggtttggatatgggtactagttccgttggtctggcagtgacggatgagaactataagttataccgtgttaaaggtaaagactattggtgctctcgtaccttcgacgaagctgacacggcggtggaacgccgcactaatcgtattagccgccgccgtcgccaacgcgaagtggcacgtttggggattttgcgcgaattgttcgcagacgagatcgcaaaggtcgatccgggtttctacgcccgcctggatgaatccaaataccacctggaagatcgcgataacaagcaaccgtacgcaatcttcgccgacaaaggttacaccgacaaggagtattacgcacgttatcccacaatcttccacctgcgttcagaactcattgatagcgataaacctcatgatgtacgtttggtgtacttagcactggcgaatatgtttaagcatcgcggtcacttcctgaatgacagtttatcgagtgacaagccactggcggataccacggaagcctatagcaacttttactatactgcgtccgaactgagtatttcgtttcctgccgaagcacaaccggacagtatcgacgcagcttccctggaagccctgttgggcgataagggagtcagccgtacggacaaagccaagaatatctgtcagtatctggcgattgataagaagacgtcaaaacccctgtacacactgatcaatttaatctgtggcttgaacatcaagctcattgatatttacggggccgagctgatcgatgaggagaataagaagctttcgatcggctttcgtgatagttcgtacgagcaacaagatgcggacggtcgtaaattattaggagagaattacgctattatcgacgcggcgaaggagcttcatgacattggactgctgagcagtatcatgaagggatataagtacctgagccaagcgcgtgtagccctgtacgaggaacacgcggccgacttaaagaaactgaagagtgtgctgaagcgttacgataaagactcgtaccgtaaggtgtttcgttcgatggatgagggcagttattcggcttacatcggttctgttaattctggtacgaaaattcgtcgtggggttaaagatggtagcgcggacacattttgtaagtccatgaagaaggttctggagaaactgccaaaagacgacatggacgttcagtacctgctggcgaaggcgaccgacagttctctcttgccgaagcaactgaccttcgagaatggcgtgatcccgaaccaattacacgcggcagagatgaaagccatccttcgtcaagccgagaagtatttgccgtttctcttagaaaaggatgagtacgacctgactgtgagccaacgtatcattcaattatttacatttcgtattccgtattacgtaggaccgatcggaaagaaccatgcaggcgagaaaggttataacatttgggctactcgtcgcgcaggcgaggaagatggccgcgtgtacccgtggaacttcgagcaaaagatcgatactaaggcagcagcggagaaattcatcgaacgtatggttcgtcattgtacttatattaatggagaacgtacccttccgaagtgtagcttattatacgagaagtatatggtactgaacgaactcaataatctgcgcattaacggggagaagccggcggtgtcagtgaaacaagacatttataccaaactgttttgccgtggcaaacgtgtaacgatgaagatgctgaaagactatctctacaactcgtcccttatcccgtcgaaagaggacgtcgtgatttccgggatcgataatgggtttaatacgtcactgacgagcgtagggaaatttcgtgggatcctgggcgatgcggtgttcgcggatagtaatcaaaagatgattgaagacatcatcttttggggcacagtttacggaaacgataagaaatttctgaaggaacgcattgaagaggtctatggcgatcgccttaaccacgacgagattaagcgcatcttaggctttaactttaacgactggggcaacttaagccgtgagttcctggaactggaaggggagtgcgaatgtggtcgctgttccatcatccaggcccaatggaacacgaaccacaacctgatggaattacttagcgatcaatttaccttcaagaacgaactggagaagaagacgggatcagcggagaaagcgttagcggattggagcatcgacgatttagaggggaagtatctgtctgcgccggttaagcgtatgatttggcaaacgattaagatgttacgcgaagtgtgcgaagttacaggccgtaccccggacaaagtgttcgtcgagatggcgcgtgaagatggtgagaaaggcgctcgtactgtgagtcgtaagaagaaactgttagatctctacgatgccattaagcacgaggagcgtgaattagcaaaggtgtttagcgacgagatcgattctaagactgaggcagactttcgtagtaagaagctctacctctattatctgcaacagggtcgttgcatgtattccggcgacattatccacctgtcagatttaatgaacgataacctgtacgacattgatcacatttaccctcgtcacttcattaaggacgattccctggagaataacctggtactggtaaagaagcaaatcaataatcgtaaacaagacacctttcctattgaacgttcgatccaagaggacatgcgtcccttttggaagtcgcttgccgattcgggattcatttcagcggaaaagtacaaacgcctgactcgtcgcgacgcctttacggacgaagagaaagcggcctttatttcgcgtcaactggtagagacgcgtcaaggcaccaaggcgattgcagacatcctgaagcaagcactgccagacacggagattgtgtacgtcaaggctgggttagtatctgactttcgccaaaagttcgaactttataaagtgcgtgccctcaacgacactcaccatgcgaaggatgcatatttgaatattgtggtgggtaatacttattccaccaaattcacgaacaacccgctcaatttcatcaaggcgggcgctaaacgtccacaagataatcaatttaagtacaacatggataagattttcgattataacgtgattagtcgtggagaacgtgcatggatcgctggttccgacggcagcatctgtacggtgaagaaattcatgagtcgtaacacggtactgatcacccgtaaagcaaaggaagttcatggcgcgctttcaaataaggcgaccatctggggcaagaacgtggcgaaacccggtgcctacttacccgtgaagtcaactgacctgaaagcgcaagacgtaaccaaatatggtggtatcacgagtatcgcgaatagcggctacaccctcgctgaatacaaggttaatggtaagactacgcgtagtcttgaggcgctgccagtgtatctgggtcgtgctgagcaattaaccgaaaagactgtcgtggactatctgtcttcgtccctgcaggaaagttcgaagaagaagatcgaagacattcaggtccgtaaactgtttatcccacaaggttccaaggtgaagatcgatggcttttgctactacctgggcggtaagaccggcgacagcatctacctgaacaacgcagtgcctttgtatttatccagcactagcgaggagtatctgcgtaaactcctgaaggccgtggaaaataacaattataatgagcgcgacaagaatggtcagatcatcctgaccgcgccgaagaatgtccagctgttgtcgtcgatcttcgacaaattacgttcgaaaccgttctccaacaataagtggaacatttatttcagcatcgtgaacggcaaggagaccaaggtggagcaacttttcagtaagctgagcatcgacaaacaggcggaagtaatctcccaaattgtgatttggatcaactcaagccgtcagaatgtgaacctgagcctgatcggcggttcggcgcacagcggcacgcaagcgctcagtaagaccgtgtcgcgtctgaacgagtgtatgctgattagccagtctatcaccggaatttacgaacactctgtggatttattaacaatc

SEQ ID NO: 5588 - DNA, 3075 bp, synthetic construct
  misc_feature 1..3075: note = Description of Artificial Sequence: Syntheticpolynucleotide
  misc_feature 1..3075: note = MG1-4 sequence codon optimized for Human
  source 1..3075: mol_type = other DNA
atgaagaagaaagtgttcgcctttgatctgggaaaggccagcattggttactgtgttcgcgatggattcaacatcaatgaagcaaactctataatcatcgataaggaccatgctgagactatgagtctgagagatcgtcggagaatcaagaaaacattagacgcacatcatgccagggaagagtactttaataaagtctggagcggcgtgggcctcaacatactggacaagaacaacaataattttaaaaaagagtttcctagcaaaaatgaggacgtaatttatacttcttgcctgctgcgcatcgctcttctccagaaccaaaagctggaggaatggcagatctacaaagccctgtacaacgcatttcagaggaggggatatgatgtcaacatcgcctggaagagtgtccaaacagatgacgataaggagaacatcgagaggatgaaaaaatacacttgcgagaacgacatagaacttattatctcagacgaatacaagtatccatgctattacgatgcacttcggctcggactgtggaatgaagacgaaccaaccaagcttaaccgttctatcccccagcataattctaataaagtgcgaaccacagaatacgtggccccacgtgaactggtggagaaggaattaaagcagttgtggttaaacgcccagctccagttacctcaattgaattctatatccgccgaagagttcctgtatggcgagtacaagatcccctacggctcatgcgtgcaaaaagaattcaagcagtacagagggactaaaaaagactggcagggggttctctgtcagaagatacctcgcttcgacaaccgcatcattgccaagtgcaagctgcttcccaagaggaatgtgtgcaaagcgaatacaatcgagaatgtgtcatttgtgttactgatgaagctgaagaacctgcgattcaccgtgatctccggagaaaagttacgcctgtctccagtacagatcaagcagatttatgagaactggctggaaaaggtggaggacacttataataaggacctcgagaaggcagaaaagctcgggaaagaaaatcctgagaagagactgaacatcacaatcactcggcaggaaattgagaagataatcggtgaaaaaattatcgacaaaatagaacccatgaaggctgacatctcaggcagatcatctttctgtcgaagagcttgccagattatgaacaaaatcattctggacggcgaactctatcctcagaatgtggatataagcgaattcgtcgaccgggataatgctaagaacggcatcacagaagaagagatccagtctatgctctccaaaattggtgattggaacaatctgtacatccccgataatcgggaggagaatgcgcagaatgcctcaaatagtcgaatcaagacagatatcatgttggggaacattaccaatcctatcgtgcgcaaccgcctgcagatattccgggacctgctcttaaaccttgccgaaaagtacgggacccctgatgaggtgatcttcgaattcgttcgagatggagctgacaacagcttgtatgggtcaaagaaagcccaggacacagagcggtttatgaaacaacaagagaaagagaacgaacagatcataaacgaactcaaggatgctggactctacgtcaatggacagaatcacgcgaatgcaacgtacttcctgatgcacaagctgctgaagtcacaaggaggcaaatgtatttattctggacaaaacatttcccctagtaattacgacgaatgcgagatagaccatatttacccaagaactctcgggggcaatgatgcattgtataacaaagtggtatgctaccgccgcgaaaatcaggataagaaaggtagaactccttacgaatggctcagtcctgactcagacaagtgggcaaattacgtcaaccgtttgaacaagatcaagaagcagcttggtaagaaaaaattcgagctcctgacatccaaaccagaagactgtgaaaaactgatcgaatcttacaacggactcgccgagacgtctcacatcgctcgtgtagcacagcaaatgacagccttcatcttcggatggggactccaaatccagggcgaatcccggaggatcttcgttaataatgggagcagcacatgtgcaatcagaaaacgctacggattaaacaaactgctgggcgataacctcaagaagaaccgcagcaacgataaacaccacgctcttgacgcaatctgtatctctttcagcagggactttaaatacgataaggaaattaagaaagacatcatcaagggattcaacccggagatagtcaagaacgcaattgataagatcatgccctacccttacgctaacgataagcccttcaaggggaacacaaagcctttggaaacgatctacggactgcggacttacggtgataagagttatattactcaacgggtggagctgaacagcatcgacaagaaggctaccaaaatcaagagtatcattgatgagactatcaagaacgacctgttgaataagctgaaggaaaacccgaccgaacaggaatggaaattgatgctccagaattatatccatcctaaaaagcagaccaaggtgaaaaaggttatgatctccgtttcagagggtgaaatcacaaaagactcaaacaacagagaacgcatgggagagtttgttgacttcgggactaagggaactcagcatcagtttaaacattccaaaaggcataaaggacagatcctgtactttaacgagaaaggtgttgtggaggtgatgccggtgtattccaacattaaaacaacagacgtcaaggacaaactgcaaaacatgggctgtaaactgtataacaagggccagatgttttactctgggtgtctggttgacatcccgaagccttttaaggccggatcaaaggagtaccccgcaggtcgttatcagataaagaccattcggtccgacaaagtggcagaacttgaagatgcgtgtggcaataagatcagtacaaatgtcaaatacctggtgccagccgagtttaagaaggttgagtcaaaa

SEQ ID NO: 5589 - DNA, 3177 bp, synthetic construct
  misc_feature 1..3177: note = Description of Artificial Sequence: Syntheticpolynucleotide
  misc_feature 1..3177: note = MG1-6 sequence codon optimized for Human
  source 1..3177: mol_type = other DNA
atggaaaaagaaaagaacaaccatgtgtggggttttgatattgggaagggcagtctgggcgaagcagtgcgagtgggcggcgattttaagcacattgcctccgttctgcttgacccggagtttggagaaattaaaaccgccgctctcgcccgcaggcagatgcgcacgcgcaaggcccataaggcaagggaaaaatggctggaggagtgcctggatggaactggagttgagatcttaaagcgtcgtgaggttgggatagttgatggacagtggcggttgatatcaaaaggcgatgaacgcttggagcgggaattcccacccaatggcgaagaagtgtgctataatagtattgccctgcgttgtaaactgctcctgggagagaagctggaaggatggcaagtcttcaaggccttaaattctgcgatccaaaagaggggttacgatgaaaatatcccctggggcgaggctgaagagaagtccagcaagaaggacgaggacgactacgctcaaaagctgtcccagtacgagcgcgagaaaagtgaattgtttgagtctttcgctgacggagagaagtatgatttcccttgtttcttcaaagcatacaaaatggggttgtggagccccgaaaaccccagacgcgttgaggttaggatcgactgcagagctcaaaaagctaagtcctatgttgtagccagaaagtatgttgaaagggaattcgaatgtctggttgaagcggccgccaaatttttccccaagctcaagggccgagcaaagttcatcttgtacggcgtgagcgagactccctacgcgagctattacgggaacatgaggaaaaaattcggtcttaaacgaggcgcggagagcgattggaccgcactcgggcagaaagttccccgattcgataataggattatcgacaagtgcagattgataccacggatgaacgtttgcaaaatccggccactgaacgaggcccgtaacgagaaagatctgttgtactacgaagtgaccttagctttgaagttacttaatcttagattcttccgcaactcaaatatagagcaactcacatttgaagagtttaagaaagcatttgagattgcctccggagccaagtataagatgacgaagactgccatgaaaaaatttctgaagtccatcagcgccactgcactcggagacgactacgccgaaattgaacctcccaaagagtcagggagagcatccttctcacggcctgctatggacattttaaaggaattgattttctctgggatgccccctagagagttctacggacgcaaaattccagagatctccaacaccgacaagaataagggtgtggtggcgagtgatttagattttatcaaactcatgggcgattgtccctggggaggcatttttataccagacgtgcagacttaccagtttgctaacgctgctttccccaatcccgacgctcaaattaataaattgatcggctcacagaataacccgatagttagacatcggttgaccttctttttcgaacgaattaagttcctggaatcaaagtatggagtccccgacaaggtggtgttggagttcgtgcgggacgacttcatgggcgagaaggaaaagaaggagatgagaatcgccatgaaaaagcgggccgaagagaagatgatgattgccaaggatctggacgagcatgggttcaagggcggcaacctccttctgaagatggaattgtatcgtaaacagaacggaatttgtctgtacacaggagacgccctccctcttagtgaactcgcaactctggagatagaacacattgtgcctaggtcccgtggcggacctgacgctcaatacaattacgtgatcacaagggaaaagaccaacaaattgaagggggacaagaccccatacgagtggctcagcagcgatgccaaagaatgggccagctacacagaccgcgtgaatgcatgtgcaaaagcccttggaaagaagcgttgcaggctgttgctggaaaaagacgccgaggagctggtggaaaagtacacagctcttgctgaaaccgcacatattgccaaactggcccaaaagattgtatgtatgcacttcggattccagtttggaggattgagcggaacaaagcgggtcttcaccgttccaggcgctctgacaagtaggatccgtaagttctacggactcgatagaattctccataatgccgcggccgagtcagagaacctgagttttgaagaatttctcaaattcagtgaggacttggaaaagaaaaacaggaaaaacaaaaaacatcacgctctggatgctatgtgtctgtgctttgcccctactggagtggacagccggagggccaagctgggggaaatcctccccgagaaactgcgtagcgagaaagccgccagagagtttttcaagtcctatctggataagatcatgcccgtcgatgttgctccaaagaaacctcggctggaggacggaatctacagcaaaagaatcatcggcgggaaggcctgcatggtgaagaggaataacctggttgatctggcatacaagtcaggcctgaaacctgtcttcgatattccaaccctcatcaagctcgtggataagaaggagaagggaatcatcaatccacagattaggaaaatgattggggaattcgctgccactaaccctgacgagtccgcttggaggaaatggtgtgaggaggtccgtctgcccagtaaaagcgggcttggtgccagggtcctgcgggttctcgtgtactacggcgaggctgacgagtacaaggacctcagcaaagatgggtgcggcgcctacaggaagggagacgggcataagggacaagtggtatgggagtccgtggatggaaagtactatgtcgagcctgtctacgtccacgcctccaaggctggcgtcatggcagccttgaacgcgaatccgaaaaaaaagagaatttgcggaatgttcaatagccactgcacggtagacgtgggagacgtttataacgatcgaggcgattttattttgcccgcaggaagatatatggttaacactatcctgacaacaggcaggtgcgtattaacaaatgcagacggcgaaaaaagaaacccaatcaacattaactaccttatgcgagctgggatgcggcgggtcgaactgtcagagttg

SEQ ID NO: 5590 - DNA, 3402 bp, synthetic construct
  misc_feature 1..3402: note = Description of Artificial Sequence: Syntheticpolynucleotide
  misc_feature 1..3402: note = MG3-6 sequence codon optimized for Human
  source 1..3402: mol_type = other DNA
atgtccacagatatgaagaattatcggatcggtgtggacgtgggcgatcggtcagtgggcttggcggctatagaattcgatgacgacggcctccctattcagaagctggccttggtaacattccggcacgatggggggctggatcctaccaaaaataaaactccgatgagccgtaaagagactcgaggaattgccaggcgcacaatgcgcatgaatcgtgagcggaagagaagattaaggaacctcgacaacgtgttagagaatctgggttacagcgtgcccgagggaccagagcccgagacatacgaggcctggacatctagggccctcctggcttccattaagctggcctccgctgacgagctgaatgagcaccttgtcagagccgttaggcacatggctagacaccgcgggtgggctaatccttggtggagcctggatcagctggagaaggccagccaggagccttctgagacttttgagataatccttgcccgtgctcgcgagcttttcggcgagaaggttcctgccaaccccaccctgggtatgttgggggctttagcagctaataacgaggttctcttgcgcccccgtgatgaaaagaagcggaagactggctatgttagaggtactccactcatgtttgcgcaagtccggcagggcgatcagttggctgagcttagacgaatttgcgaagtacaaggcatagaggaccaatacgaagcactgcgcctgggggtgttcgatcataagcacccttatgtgcctaaagagagggtgggcaaagaccctctgaatccgagcacaaacaggaccattcgggcaagtttggagtttcaagaatttaggatcctggactcagttgctaacctccgtgtgaggatcggtagccgggcgaagagagaactcaccgaagcggaatacgacgccgcggttgagttcttgatggattatgccgacaaggaacagccatcctgggccgatgtcgccgagaagataggggtccccggcaatagactcgtggcccccgtgctcgaagatgtccagcaaaagacagccccctatgatcgctccagtgcagcatttgaaaaagcaatgggcaagaagaccgaagccaggcaatggtgggaatccacggacgacgaccagctgaggtccttgttgatagcttttttggtagacgctactaatgataccgaggaagcagccgcggaagcaggcctgtccgagttgtataaaagttggcccgctgaagagcgcgaggccctctccaacatcgattttgaaaagggccgagtggcatattcacaagaaacactgtccaaactgtctgagtatatgcatgagtatcgcgtaggcctgcacgaggcacggaaggctgtattcggggtggacgacacctggcggcctccattagacaagctcgaagaaccaactggtcagccagccgtggatcgcgtcctgaccattcttagaaggtttgtattggattgcgaacgccagtggggccgcccccgcgcgatcacagtggagcacacacggaccggccttatggggccaactcagcggcagaaaatcctgaatgagcagaaaaagaaccgagccgataacgagcgtattcgggatgagttgcgcgagtccggagtggataacccaagccgggctgaggtacgaagacatttgatcgtgcaggagcaggaatgtcagtgtctttattgcgggaccatgatcaccaccacaacctctgaactcgatcacatagtgccacgggcagggggagggtcatccagacgagaaaacctcgccgccgtatgtcgggcctgcaacgctaagaagaagcgagagctcttctacgcttgggccggacctgtgaagagccaagaaaccatcgaaagagtgcgccagttgaaggctttcaaggactctaagaaagccaagatgttcaagaaccagatccgcaggctgaaccagactgaagcagacgaaccaattgacgagcgctctttggcttccacctcctatgctgctgttgctgtcagagaaaggctggaacagcattttaacgagggcctggccctggacgacaagtctcgggtggttcttgacgtgtatgccggggccgtgacccgtgagagtcgtagggctggtggcatagacgaacgcattttgttgagaggggagcgggacaagaaccgttttgatgtgagacatcacgcagtggacgcggccgtgatgaccctgttaaacagatctgtggccctcacgcttgaacagcggtcacagctccgcagaacattttatgagcaaggtctggacaagttagacaggaatcaactcaaacctgaagaagactggcgcgatttcacggggctcgcacccgcctctcaggagaagtttctggaatggcggaaggctgccactatcctgggcgacctcttagcggaggccatcgaagacgactctatcgcggtcgtaagcccacttcgtctgcggccacagaatggaagcgtccacctcgagacaataagcgcagtgaaaaaacaaacgttgggatcagattggcccgccgacgcggtcaaacgtatagtggaccctgagatctacttagcaatgaaggatgccctgggaaagctgaaagagttgcccgaagacagcgctcgctccctggaacttccagatggacgatttgtggaggccgatgacgaggtgcttttttttccagaaaacgcagcaagcattctgactccccgcggagtggccgagatcggaggctccattcaccatgcacgtctgtacggatggctgacgaagaagggtgagttgaaggttgggatgcttagggtttatggagcagagttcccatggttgatgagagagtccggtagcagaaacgtgctgtccatgcctatccaccgcggcagtcagagctttcgggatatgcaggataccacacggaaggcagtggagagtggcgaagctgtcgagttcgcttggatcacccagaatgacgagctcgaatttgaccccgatgactatatcgcccatggcggaaaagatgagttgagacaattcctcggctttatgcctgagtgtcgctggagggttgatggtttcaaaaagaactatcaaattcggatacgccccgctatgctgtccagagagcaactgccatccgatatccagaggaggctggaatcaaagacactgacgaaaaatgaatccctcctgctgaaggctctggataccggcctggtagtggcaattgggggcctgctgccactcgaaacgctgaaggttatccgtaggaacaacctcggattcccccggtggagaggaaacgggaatttgcccacgtccttcgaggtgaggagtagcgctctgagggccctcggagtggagggc

SEQ ID NO: 5591 - DNA, 3393 bp, synthetic construct
  misc_feature 1..3393: note = Description of Artificial Sequence: Syntheticpolynucleotide
  misc_feature 1..3393: note = MG3-7 sequence codon optimized for Human
  source 1..3393: mol_type = other DNA
atgagcgaacatactaaatacagaatcggcatcgacgtgggagatcgatctgtgggattagcagccatcgagtttgatgacgatggatttcccctgtcaaacctggcgatggtaacgtataggcacgacggtggactggatcctacgaccaacaaatcacctaaaagcaggaaagagacaaggggtgtggctctccgaacaatgaggatgcggcgcagaaagaaaagccgcctgaaggatctcgacaaaaccctgcgagccctcggatatgtggttcccgcatgtgaggagccccagacatacgaggcttggaaaagcagggccctgctggccacgacaaaggttgagggggcccaagagctgggagaacatctggtacgggcagtgaggcatatggcccgtcatcgcggctggagaaacccatggtggactttcaatcagctggagatcgcgagcaccgctccttcagatacatttgcaaagatccgcgagcgggccgaaaaagaatggcctggagtggtgcccgaggaagccaccctggggatgattggcgcccttgcagcctctaataatgtgttgctgcgccctaggacctaccggaaggatcagccacggcactcaaagaaactgaatgttctgggacaagagcctatcctggtggacaaagtacgccaggaggacctccttgcagagcttcggacaatttgtaaaaagcaagacattgaggatcagtacgagaaattagcgcaggcagtattcgagcagacaaggccctacgttccactggatagggtcggcaaggatcccttgcaaccaaataagtcccgcgcctcacgcgcatccctggagtttcagcgcttccgcattcttgacgctgtggcgcatcttagagtgagggtgggggcgtcagaccgccgggcgctgacagacgaagagcacgataaagccgtccatttcctgatgggctacagtaagaaagacgtgccaacttggggtgatgtggcagacgagattggtgtcgagcccgcccatttaattgccccagtgatcgatgacgtgcgcttgaataaggcgccttatgatcgctccagcaccgaatttgaacagaaaatgaaaaagaagacaagagccagacagtggtgggacgaagctaatctggaatcccgtagtcaactgattctcttagtctctgaccctactgatgagacgatgcgcctcgccgaggtgtccggtctgtatgaggtgttcgagtcctggcctgacgaagaaaaggaggcactcgagggcctcaaggtcgaatctggcagggcagcttactctaccgatactttgaataagcttagcgaccatatgcgactcaaaagaatcgatttacacgaggcccgcaaaattgcgtttggcgttgacgacatgtggcacccaccactggataggatagacgaacccactggacagccgactgtcgatagggtgctgactatcgtgaggcggtttattttcgattgcgaacgcgcttgggggtgtcccgaaaatgttgtgatcgaacatgcgcgcacaggcttgatgggcccggcgcagagggctgacgtcctcaacgagatcgcaaagaacagaaagaaaaatgacaaaattcgagaagatctccgggccggaggaatcaacaaccctacccgcgcagacattcgcagaaatgcgattgtacaggatcaggagagccagtgcctgtactgcggagctacgataggcgtgagctactcagagctcgatcacatcgttcccagagctggcggcggtagttcccgccgggaaaacctcgctgcagtctgccgggcatgtaatgatagtaagaaagatacaccatttgccgtgtgggccaagaataccagtagacccgtgacgttggagggaacaatacagcggcttagggagcttaaagccttcaagcggcctaaggaccggagaatggtggatctgataatacggcgactgaagcagactgaaaaggacgatcccattgatgagcgaagcctggcctctacaagctacgcagctaccgccatcagagagcgcatcgagcagtatttcaatgagaaggctgagaagctcgacttggccaaagtgcatatcgacgtgtattccggatcattgaccagagaatcaaggagggccggggggatcgacaaaatggttcttttaaggggtcagtccgataagaacagattcgatgtgcgacaccatgcaatcgacgccgctgtccttactctgctgaataggtctgtcgcggtcaccctggagcaacgccgactgatcaaacaacagcgggaatattctctcgagaagtcccggagagaaagggataatgtgtggcgcgattttatgggactgggtccggccgcccaggaaaagtttgccaagtggaagaagactgcttacgtgctggccgatatcatcaaagaggcaatttcaaatgacgcaatccctgttgtcagccccctccggctgcgtcctcaaaatggatctgtgcaccttgacaccgttgatgccgtgctcgaaagaactattggcgatgcatggactgtcgaccaggtgcatcggatagtcaacccacagatctatctggcctttgccggatacttgggaaatcagaaggccctggaccctgacagcagcagagtccttgccttaaacgacggcaggaaactcacagcggaagacgtgatctatgtgttccctgagaaagccgcctccattttaacccctaggggagtcgtaaaaataggggagagcgtacatcacgtgcggctgtacgcttggaagaataggaaggggaaagcagaggtcgggatgctcagagtgtttggcgcagagtttccttggctgatgcgagagagcggggtaaaagatgtgctcagggtacctattcatacgggcagtcagtcctacagagacttgtcctttactgtgcgcaagaacatagaaaaaggcgaggcggccgagattggatggttgacacaaaacgaggagcttgagttcaatcctgaaagctacttgcaggaaggaggcaaagataaactggctaaattcctcgcatttctccccgagactcgctggcgcgttgatgggtttcctatgcccgataagcttcggattcggcctgctcttctctcacgcgaggaaatcccagaaggtgtgttccggaccgaagaacagagtcttctggaagaggctctcaccaaggggctgataattgcaactaaagggctcttgtctctccctgacgtgaaagtcttgcgccggaacaacctcggcattccgcggtggcggggtggatcctacagacccgtttccctggatatccagagggccgcactggcagctctggatgaacaggag

SEQ ID NO: 5592 - DNA, 960 bp, unidentified
  misc_feature 1..960: note = Description of Unknown:uncultivated organism with predicted taxonomy: unclassifiedVerrucomicrobia
  misc_feature 1..960: note = MG1-1 species 16S rRNA gene
  source 1..960: mol_type = other DNA
acggagagtttgattctggctcagaacgaacgctggcggcgtggataagacatgcaagtcgagcgggatacacagggtagcaatattctgtgtgttcagcggcgcaagggtgcgtaacacgtgggtaatttgccatgaagtctggaataacttgctgaaaggcgagctaatgccggatgtgacttccgaaaggcatcttttggaattcaaagttggggaccttaaccggcctgacgctttttgataagcccgcggtctatcagctagttggtgaggtaacggctcaccaaggctaagacggatagctggtctgagaggacgaccagccacactggaactgagacacggtccagacacctacgggtggcagcagtcgagaatttttcacaatgggcgaaagcctgatggagcgacgccgcgtgggggatgaatggcttcggcccgtaaacccctgtcatttgcgaacaaaccttactggtaaacaaccagtgagctgattgtagcggaagaggaagggacggctaactctgtgccagcagccgcggtaatacagaggtcccgagcgttgttcggattcactgggcgtaaagggtgcgtaggtggtgaggtaagtcggatgtgaaatctccgggctcaacccggaaatggcattggaaactaccttgcttgaggatttgaggggggattagaatacttggtgtagaagtgaaatgcgtagatatcaagtggaacaccagtggcgaaggcgaatccctggaaaatacctgacactgaggcacgaaagctaggggagcaaacaggatgagataccctggtagtcctagccctaaacggtgcttgcttgctgtaagaggaatcgacccctcttgtggcggagctaacgcgttaagcaagccgcctgggaagtacggtcgcaagattaaaactcaaagaaattgacgggggcctgcacaagcggtg

SEQ ID NO: 5593 - DNA, 1527 bp, unidentified
  misc_feature 1..1527: note = Description of Unknown:uncultivated organism with predicted taxonomy: unclassifiedVerrucomicrobia
  misc_feature 1..1527: note = MG1-2 species 16S rRNA gene
  source 1..1527: mol_type = other DNA
tcggagagtttgattctggctcagaacgaacgctggcggcgtggataagacatgcaagtcgaacgggatcattccggttggcaacaatcggggtgattcagtggcgaacgggtgcgtaacacgtgggaatctgcccggaagagggggatagcccgccgaaaggcggattaataccgtatatattgaaagtgggggaccgcaaggcctcacacttccggatgagcccgcgtcctatcagctagttggtggggtaatggcccaccaaggctttgacgggtagctggtctgagaggacgaccagccacactgggactgagacacggcccagacacctacgggtggcagcagtcgagaatttttcacaatgggggaaaccctgatggagcgacgccgcgtggaggatgaagggcttcggctcgtaaactcctgtcaccacagacaaatgattcacggtgaacatccgtgaagcttgatggtatgtggagaggaagggacggctaactctgtgccagcagccgcggtaatacagaggtcccaagcgttgttcggatttactgggcgtaaagggtgcgtaggaggtctggaaagtcgggtgtgaaatctcaccgcctaacggtgaaattgcgctcgaaactcccagactcgaggaccggagaggagaacggaattcctggtgtagcggtgaaatgcgtagatatcaggaggaacaccaacggcgaaggcagttctctggaaggttcctgactctgaggcacgaaggccaggggagcaaacgggattagataccccggtagtcctggcagtaaacggtgctcattaggtgtaggcggattcgaccccgtctgtgccgcagctaacgcgttaaatgagccgcctggggagtacggtcgcaagattaaaactcaaagaaattgacgggggcccgcacaagcggtggagtatgtggcttaattcgatgcaacgcgaagaaccttacctggtcttgacatgcattgttcatccgtggaaacacggtggcccgcaagggcgaattgcacaggtgctgcatggctgtcgtcagctcgtgtcgtgagatgttgggttaagtcccgcaacgagcgcaacccctatgattagttatatgcgcaagctcactagtcagactgccctgttcaacggggaggaaggtggggatgacgtcaagtcaggatggcccttatgaccagggctgcacacgtactacaatgcccactacagagggtcgcgaagccgtgaggtggagccaatcccagaaaagtgggcccagttcggatcggaggctgcaactcgcctccgtgaagttggaatcgctagtaatggcgcatcagctacggcgccgtgaatacgttcccgggccttgtacacactgcccgtcacatcatgaaagccggttgtacccgaagtcgtttggctaaccgcaaggaggccggcgcctaaggtatggctggtgattgggatgaagtcgtaacaaggtagccgtaggggaacctgcggctggatcacctcctt

SEQ ID NO: 5594 - DNA, 1472 bp, unidentified
  misc_feature 1..1472: note = Description of Unknown:uncultivated organism
  misc_feature 1..1472: note = MG1-3 species 16S rRNA gene
  source 1..1472: mol_type = other DNA
taagagtttgatcctggctcaggattaacgctggcgggatgcctaacacatgcaagtcgagcggcagcacttcgggtggcgagcggcggacggctgaggaacacgttggtacctgccccaaactcagggataagccttcgaaaggaggtctaataccggatatccggaaacgggaaagatttatcggtttgggaggggcctgcgtcgtatcatgcttgttggtggggtaatggctcaccaaggctttgacgcgtatctggtgtgagagcatgaccagacagagtgggactgagacacggcccacactcctacgggaggcagcagtgaggaattttccgcaatggacgaaagtctgacggagcaatcccgcgtggaggacgacacctttcggggcgtaaactccttttctgagggaagaaattttgacggtacctcaggaataagcatcggctaactacgtgccagcagccgcggtaatacgtaggatgcaagcgttatccggaattactgggcgtaaagcgttcgaaggtggtgatatcagtctggtgttaaatccctgcggctcaaccgaggaatcgtaccggatactgtatcactagaggaatgcagaggaagctggaattcccattgtaggggtaaaatccgtagataatgggaggaacaccaaaagcgaaggcaggcttctgggcatttcctgacactgcgcgaacgaaagcgtggggagcgaaagggattagatacccctgtagtccacgccctaaacgatgatcactcgatatacgccggctcaatcccggtgtgtgtccaagctaacgcgttaagtgatccgcctgtggagtacggccgcaaggctaaaacataaaggaatagacggggatccacacaagcggtggagcatggggtttaattcgacagtaagcgaggaaccttaccaagacttgacatctttcgaattttctagaaatagaaaagtgccttcgggaacgaaatgacaggtgctgcatggttgtcgtcagctcgtgccttgaggtgtgcggttaagtccgtgaacgagcgcaaccctcgtcgtgtgttgtatttttcacacgagactgcccgttttacgcgggaggaaggtgaggatgacgtcaaatcagcatggcccttatgtcttgggcgacacccgtgctacaatggccggtacaaagggcagccaacccgcgagggggagcgaatcccaaaaagccggtctcagttcggattgaagtctgcaactcgacttcatgaagctggaatcgctagtaaccgtgaatcagccacgtcacggtgaatatgttcctggatcttgtactcaccgcccgtcaagtcacgaaaggtgggggcgcccgaagccgtgttatcccctcggggagcatgaccacggtgaaaccactgattgggactaagtcgtaacaaggtatccgtaggggaatctgcggatggatcacctcctt

SEQ ID NO: 5595 - DNA, 1542 bp, unidentified
  misc_feature 1..1542: note = Description of Unknown:uncultivated organism with predicted taxonomy: unclassifiedVerrucomicrobia
  misc_feature 1..1542: note = MG1-6 species 16S rRNA gene
  source 1..1542: mol_type = other DNA
acggagagtttgattctggctcagagtgaacgctggcggcgtggttaagacatgcaagtcgagcgagaacaaaagcgtagcaatacgtggatgagaaagcggcgaacgggtgcgtaacacgtaagcaacctgccctaaagacggggatagctcggggaaactcgaattaataccggatgtggtccttaaacacatgtaagaggaactaaagcttgagaaggcgctttaggaggggcttgcggcctatcagctagttggtaaggtaacggcttaccaaggcaaagacgggtagcgggtctgagaggacgatccgccacactggaactgagacacggtccagacacctacgggtggcagcagtttcgaatcattcacaatgggggcaaccctgatggtgcaacgccgcgtgggggacgaaggtcttcggattgtaaacccctgtcacacaggactaaccgcaaggttcatagccttgtctgaattaactgtgagaggaagtagtggctaactccgtgccagcagccgcggtaatacggagactacgagcgttactcggattcactgggcgtaaagggagcgcaggcgggatagtgtgttaggtgtgaaatgccggggcttaacttcggagctgcgcctaaaactattattctagagtgctggagaggtaagcggaatttccggtgtagcggtaaaatgcgcagatatcggaaggaacaccgaaggcgaaggcagcttactggacagaaactgacgctcatgctcgaaagcgtggggagcgaaagggattagatacccctgtagtccacgccctaaacgttgtacactaggtattggaggaatcatccccttcagtgccccagctaacgcgataagtgtaccgcctgaggactacgaccgcaaggttaaaactcaaagaaattgacgggggcccgcacaagcggtggagcatgtggcttaattcgatgcaacgcgaagaaccttacctgggtttgacatgtatttgaatatatgtgaaagcatatagtccttcgggacaggtacacagatgctgcatggctgtcgtcagctcgtgtcgtgagatgttcggttaagtccggcaacgagcgcaaccctcgccctatgttaccagcgggtaaagccggggactcttaggggacaagcctgtatacaggcgggaaggtggggatgacgtcaagtcagtatggctcttacatccagggctgcacacgtgctacaatggccgacacagagggatgctacgtcgcgaggcgatgcgaatctcgaaaatcggtctcagttcggattggatgtctgcaactcgactccatgaagccggaatcgctagtaaaggcgtatcagctacgacgccttgaatacgttcccgggccttgtacacaccgcccgtcaagtcatgaaagccggttttgcccgaagttcgtgagctaacccgcgaggggggcagcggcctaaggcaatgctggtgattgggactaagtcgtaacaaggtagccgtaggggaacctgcggctggatcacctcctt

SEQ ID NO: 5596 - RNA, 28 nt, synthetic construct
  misc_feature 1..28: note = Description of Artificial Sequence: Syntheticoligonucleotide
  misc_feature 1..28: note = test target sequence
  source 1..28: mol_type = other RNA
cgtgagccaccacgtcgcaagcctcgac

SEQ ID NO: 5597 - protein, 7 aa, Simian virus 40
  REGION 1..7: note = SV40 NLS
PKKKRKV

SEQ ID NO: 5598 - protein, 16 aa, Homo sapiens
  REGION 1..16: note = nucleoplasmin bipartite NLS
KRPAATKKAGQAKKKK

SEQ ID NO: 5599 - protein, 9 aa, Homo sapiens
  REGION 1..9: note = c-myc NLS
PAAKRVKLD

SEQ ID NO: 5600 - protein, 11 aa, Homo sapiens
  REGION 1..11: note = c-myc NLS
RQRRNELKRSP

SEQ ID NO: 5601 - protein, 38 aa, Mus sp.
  REGION 1..38: note = hnRNPA1 M9 NLS
NQSSNFGPMKGGNFGGRSSGPYGGGGQYFAKPRNQGGY

SEQ ID NO: 5602 - protein, 42 aa, Homo sapiens
  REGION 1..42: note = Importin-alpha IBB domain NLS
RMRIZFKNKGKDTAELRRRRVEVSVELRKAKKDEQILKRRNV

SEQ ID NO: 5603 - protein, 8 aa, Murine polyomavirus
  REGION 1..8: note = Myoma T protein NLS
VSRKRPRP

SEQ ID NO: 5604 - protein, 8 aa, Murine polyomavirus
  REGION 1..8: note = Myoma T protein NLS
PPKKARED

SEQ ID NO: 5605 - protein, 8 aa, Homo sapiens
  REGION 1..8: note = p53 NLS
PQPKKKPL

SEQ ID NO: 5606 - protein, 12 aa, Mus sp.
  REGION 1..12: note = mouse c-abl IV NLS
SALIKKKKKMAP

SEQ ID NO: 5607 - protein, 5 aa, Influenza virus
  REGION 1..5: note = influenza virus NS1 NLS
DRLRR

SEQ ID NO: 5608 - protein, 7 aa, Influenza virus
  REGION 1..7: note = influenza virus NS1 NLS
PKQKKRK

SEQ ID NO: 5609 - protein, 10 aa, Hepatitis delta virus
  REGION 1..10: note = Hepatitis virus delta antigen NLS
RKLKKKIKKL

SEQ ID NO: 5610 - protein, 10 aa, Mus sp.
  REGION 1..10: note = mouse Mx1 protein NLS
REKKKFLKRR

SEQ ID NO: 5611 - protein, 20 aa, Homo sapiens
  REGION 1..20: note = human poly(ADP-ribose) polymerase NLS
KRKGDEVDGVDEVAKKKSKK

SEQ ID NO: 5612 - protein, 17 aa, Homo sapiens
  REGION 1..17: note = steroid hormone receptors glucocorticoid NLS
RKCLQAGMNLEARKTKK

SEQ ID NO: 5613 - protein, 1053 aa, Staphylococcus aureus
  REGION 1..1053: note = J7RUA5_CAS9_STAAU (aligned to MG1-2, 6)
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 5614 - protein, 1101 aa, Actinomyces naeslundii
  REGION 1..1101: note = J3F2B0_CAS9_ACTNH_4ogc (aligned to MG3)
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 5615 - protein, 9 aa, unidentified
  REGION 1..9: note = Description of Unknown:uncultivated organism
  REGION 1..9: note = MG1-1 to 1-3 MOTIF
RHHALDAMV

SEQ ID NO: 5616 - protein, 9 aa, unidentified
  REGION 1..9: note = Description of Unknown:uncultivated organism
  REGION 1..9: note = MG1 motif 2.1
KHHALDAMC

SEQ ID NO: 5617 - protein, 9 aa, unidentified
  REGION 1..9: note = Description of Unknown:uncultivated organism
  REGION 1..9: note = MG1 motif 2.2
KHHALDAIC

SEQ ID NO: 5618 - protein, 8 aa, unidentified
  REGION 1..8: note = Description of Unknown:uncultivated organism
  REGION 1..8: note = MG1 motif 3
  MOD_RES 2: note = Any amino acid
PXGFSRPA

SEQ ID NO: 5619 - protein, 8 aa, unidentified
  REGION 1..8: note = Description of Unknown:uncultivated organism
  REGION 1..8: note = MG1 motif 4
  MOD_RES 2: note = Any amino acid
PXGFCRPA

SEQ ID NO: 5620 - protein, 8 aa, unidentified
  REGION 1..8: note = Description of Unknown:uncultivated organism
  REGION 1..8: note = MG1 motif 5
  MOD_RES 2: note = Any amino acid
PXGYCRPA

SEQ ID NO: 5621 - protein, 8 aa, unidentified
  REGION 1..8: note = Description of Unknown:uncultivated organism
  REGION 1..8: note = MG1 motif 6
  MOD_RES 2: note = Any amino acid
PXGYSRPA

SEQ ID NO: 5622 - protein, 10 aa, unidentified
  REGION 1..10: note = Description of Unknown:uncultivated organism
  REGION 1..10: note = MG1 motif 7
  MOD_RES 8..9: note = Any amino acid
PIVRHRLXXF

SEQ ID NO: 5623 - protein, 10 aa, unidentified
  REGION 1..10: note = Description of Unknown:uncultivated organism
  REGION 1..10: note = MG1 motif 8
  MOD_RES 8..9: note = Any amino acid
PVVRHRLXXF

SEQ ID NO: 5624 - protein, 10 aa, unidentified
  REGION 1..10: note = Description of Unknown:uncultivated organism
  REGION 1..10: note = MG1 motif 9
  MOD_RES 8..9: note = Any amino acid
PLVRHRLXXF

SEQ ID NO: 5625 - protein, 13 aa, unidentified
  REGION 1..13: note = Description of Unknown:uncultivated organism
  REGION 1..13: note = MG1 motif 10
  MOD_RES 5: note = Any amino acid
  MOD_RES 10: note = Any amino acid
FKALXSAIQXRGY

SEQ ID NO: 5626 - protein, 13 aa, unidentified
  REGION 1..13: note = Description of Unknown:uncultivated organism
  REGION 1..13: note = MG1 motif 11
  MOD_RES 5: note = Any amino acid
  MOD_RES 10: note = Any amino acid
FKALXNAIQXRGY

SEQ ID NO: 5627 - protein, 13 aa, unidentified
  REGION 1..13: note = Description of Unknown:uncultivated organism
  REGION 1..13: note = MG1 motif 12
  MOD_RES 5: note = Any amino acid
  MOD_RES 10: note = Any amino acid
YKALXSAIQXRGY

SEQ ID NO: 5628 - protein, 13 aa, unidentified
  REGION 1..13: note = Description of Unknown:uncultivated organism
  REGION 1..13: note = MG1 motif 13
  MOD_RES 5: note = Any amino acid
  MOD_RES 10: note = Any amino acid
YKALXNAIQXRGY

SEQ ID NO: 5629 - protein, 7 aa, unidentified
  REGION 1..7: note = Description of Unknown:uncultivated organism
  REGION 1..7: note = MG1 motif 14
LKLLNLR

SEQ ID NO: 5630 - protein, 7 aa, unidentified
  REGION 1..7: note = Description of Unknown:uncultivated organism
  REGION 1..7: note = MG1 motif 15
MKLLNLR

SEQ ID NO: 5631 - protein, 11 aa, unidentified
  REGION 1..11: note = Description of Unknown:uncultivated organism
  REGION 1..11: note = MG1, MG2 motif 1
  MOD_RES 4: note = Any amino acid
  MOD_RES 9..10: note = Any amino acid
PRFXNRIIXXC

SEQ ID NO: 5632 - protein, 11 aa, unidentified
  REGION 1..11: note = Description of Unknown:uncultivated organism
  REGION 1..11: note = MG1, MG2 motif 2
  MOD_RES 4: note = Any amino acid
  MOD_RES 9..10: note = Any amino acid
PRFXNRILXXC

SEQ ID NO: 5633 - protein, 7 aa, unidentified
  REGION 1..7: note = Description of Unknown:uncultivated organism
  REGION 1..7: note = MG2 motif 1
NNHLVRH

SEQ ID NO: 5634 - protein, 7 aa, unidentified
  REGION 1..7: note = Description of Unknown:uncultivated organism
  REGION 1..7: note = MG2 motif 2
NNHLIRH

SEQ ID NO: 5635 - protein, 7 aa, unidentified
  REGION 1..7: note = Description of Unknown:uncultivated organism
  REGION 1..7: note = MG2 motif 3
NNHIVRH

SEQ ID NO: 5636 - protein, 7 aa, unidentified
  REGION 1..7: note = Description of Unknown:uncultivated organism
  REGION 1..7: note = MG2 motif 4
  MOD_RES 4: note = Any amino acid
EFLXFRW

SEQ ID NO: 5637 - protein, 7 aa, unidentified
  REGION 1..7: note = Description of Unknown:uncultivated organism
  REGION 1..7: note = MG2 motif 5
  MOD_RES 4: note = Any amino acid
EFLXYRW

SEQ ID NO: 5638 - protein, 7 aa, unidentified
  REGION 1..7: note = Description of Unknown:uncultivated organism
  REGION 1..7: note = MG2 motif 6
  MOD_RES 4: note = Any amino acid
EFMXFRW

SEQ ID NO: 5639 - protein, 8 aa, unidentified
  REGION 1..8: note = Description of Unknown:uncultivated organism
  REGION 1..8: note = MG3 motif 1
EPQTYEAW

SEQ ID NO: 5640 - protein, 8 aa, unidentified
  REGION 1..8: note = Description of Unknown:uncultivated organism
  REGION 1..8: note = MG3 motif 2
EPETYEAW

SEQ ID NO: 5641 - protein, 9 aa, unidentified
  REGION 1..9: note = Description of Unknown:uncultivated organism
  REGION 1..9: note = MG3 motif 3
HLVRAVRHM

SEQ ID NO: 5642 - protein, 8 aa, unidentified
  REGION 1..8: note = Description of Unknown:uncultivated organism
  REGION 1..8: note = MG3 motif 4
  MOD_RES 4: note = Any amino acid
MRMXRRKK

SEQ ID NO: 5643 - protein, 8 aa, unidentified
  REGION 1..8: note = Description of Unknown:uncultivated organism
  REGION 1..8: note = MG3 motif 5
MRMRRRRK

SEQ ID NO: 5644 - protein, 8 aa, unidentified
  REGION 1..8: note = Description of Unknown:uncultivated organism
  REGION 1..8: note = MG3 motif 6
  MOD_RES 2..3: note = Any amino acid
NXXLLRPR

SEQ ID NO: 5645 - protein, 15 aa, unidentified
  REGION 1..15: note = Description of Unknown:uncultivated organism
  REGION 1..15: note = MG3 motif 7
  MOD_RES 2: note = Any amino acid
  MOD_RES 13..14: note = Any amino acid
QXDVLAELRRICXXQ

SEQ ID NO: 5646 - protein, 15 aa, unidentified
  REGION 1..15: note = Description of Unknown:uncultivated organism
  REGION 1..15: note = MG3 motif 8
  MOD_RES 2: note = Any amino acid
  MOD_RES 13..14: note = Any amino acid
QXDLLAELRTICXXQ

SEQ ID NO: 5647 - protein, 15 aa, unidentified
  REGION 1..15: note = Description of Unknown:uncultivated organism
  REGION 1..15: note = MG3 motif 9
  MOD_RES 2: note = Any amino acid
  MOD_RES 13..14: note = Any amino acid
QXDQLAELRRICXXQ

SEQ ID NO: 5648 - protein, 11 aa, unidentified
  REGION 1..11: note = Description of Unknown:uncultivated organism
  REGION 1..11: note = MG3 motif 10
  MOD_RES 3..4: note = Any amino acid
VPXXRVGKDPL

SEQ ID NO: 5649 - protein, 10 aa, unidentified
  REGION 1..10: note = Description of Unknown:uncultivated organism
  REGION 1..10: note = MG4 motif 1
  MOD_RES 5: note = Any amino acid
  MOD_RES 8: note = Any amino acid
QQFRXLQXVN

SEQ ID NO: 5650 - protein, 9 aa, unidentified
  REGION 1..9: note = Description of Unknown:uncultivated organism
  REGION 1..9: note = MG14 motif 1
  MOD_RES 2: note = Any amino acid
HXDGTSRAL

SEQ ID NO: 5651 - protein, 9 aa, unidentified
  REGION 1..9: note = Description of Unknown:uncultivated organism
  REGION 1..9: note = MG14 motif 2
  MOD_RES 2: note = Any amino acid
HXNGTSRAL

SEQ ID NO: 5652 - protein, 9 aa, unidentified
  REGION 1..9: note = Description of Unknown:uncultivated organism
  REGION 1..9: note = MG14 motif 3
  MOD_RES 2: note = Any amino acid
HXGGTSRAL

SEQ ID NO: 5653 - protein, 9 aa, unidentified
  REGION 1..9: note = Description of Unknown:uncultivated organism
  REGION 1..9: note = MG14 motif 4
  MOD_RES 2: note = Any amino acid
HXDGSEQAL

SEQ ID NO: 5654 - protein, 7 aa, unidentified
  REGION 1..7: note = Description of Unknown:uncultivated organism
  REGION 1..7: note = MG14 motif 5
  MOD_RES 5: note = Any amino acid
SELVXAY

SEQ ID NO: 5655 - protein, 7 aa, unidentified
  REGION 1..7: note = Description of Unknown:uncultivated organism
  REGION 1..7: note = MG14 motif 6
  MOD_RES 5: note = Any amino acid
SEMVXAY

SEQ ID NO: 5656 - protein, 7 aa, unidentified
  REGION 1..7: note = Description of Unknown:uncultivated organism
  REGION 1..7: note = MG14 motif 7
  MOD_RES 5: note = Any amino acid
SELCXAY

SEQ ID NO: 5657 - protein, 10 aa, unidentified
  REGION 1..10: note = Description of Unknown:uncultivated organism
  REGION 1..10: note = MG14 motif 8
  MOD_RES 5..8: note = Any amino acid
FKGVXXXXEK

SEQ ID NO: 5658 - protein, 10 aa, unidentified
  REGION 1..10: note = Description of Unknown:uncultivated organism
  REGION 1..10: note = MG14 motif 9
  MOD_RES 5..8: note = Any amino acid
FKGIXXXXEK

SEQ ID NO: 5659 - protein, 8 aa, unidentified
  REGION 1..8: note = Description of Unknown:uncultivated organism
  REGION 1..8: note = MG14 motif 10
  MOD_RES 6: note = Any amino acid
LADAVXEA

SEQ ID NO: 5660 - protein, 8 aa, unidentified
  REGION 1..8: note = Description of Unknown:uncultivated organism
  REGION 1..8: note = MG14 motif 11
  MOD_RES 6: note = Any amino acid
LGDAVXEA

SEQ ID NO: 5661 - protein, 8 aa, unidentified
  REGION 1..8: note = Description of Unknown:uncultivated organism
  REGION 1..8: note = MG14 motif 12
  MOD_RES 6..7: note = Any amino acid
EEPEVXXL

SEQ ID NO: 5662 - protein, 8 aa, unidentified
  REGION 1..8: note = Description of Unknown:uncultivated organism
  REGION 1..8: note = MG14 motif 13
  MOD_RES 6..7: note = Any amino acid
EEPEIXXL

SEQ ID NO: 5663 - protein, 8 aa, unidentified
  REGION 1..8: note = Description of Unknown:uncultivated organism
  REGION 1..8: note = MG14 motif 14
  MOD_RES 6..7: note = Any amino acid
EDPEVXXL

SEQ ID NO: 5664 - protein, 11 aa, unidentified
  REGION 1..11: note = Description of Unknown:uncultivated organism
  REGION 1..11: note = MG14 motif 15
  MOD_RES 5: note = Any amino acid
  MOD_RES 7: note = Any amino acid
  MOD_RES 9..10: note = Any amino acid
NPVVXRXMXXM

SEQ ID NO: 5665 - protein, 11 aa, unidentified
  REGION 1..11: note = Description of Unknown:uncultivated organism
  REGION 1..11: note = MG14 motif 16
  MOD_RES 5: note = Any amino acid
  MOD_RES 7: note = Any amino acid
  MOD_RES 9..10: note = Any amino acid
NPVVXRXTXXV

SEQ ID NO: 5666 - protein, 14 aa, unidentified
  REGION 1..14: note = Description of Unknown:uncultivated organism
  REGION 1..14: note = MG14 motif 17
  MOD_RES 2: note = Any amino acid
  MOD_RES 4: note = Any amino acid
  MOD_RES 6..7: note = Any amino acid
  MOD_RES 10: note = Any amino acid
  MOD_RES 12: note = Any amino acid
DXRXYXXVGXCXYF

SEQ ID NO: 5667 - protein, 14 aa, unidentified
  REGION 1..14: note = Description of Unknown:uncultivated organism
  REGION 1..14: note = MG14 motif 18
  MOD_RES 4: note = Any amino acid
  MOD_RES 6..8: note = Any amino acid
  MOD_RES 13: note = Any amino acid
VLYXLXXXRGYIXH

SEQ ID NO: 5668 - protein, 12 aa, unidentified
  REGION 1..12: note = Description of Unknown:uncultivated organism
  REGION 1..12: note = MG15 motif 1
  MOD_RES 2: note = Any amino acid
  MOD_RES 4..6: note = Any amino acid
DXIXXXFSVYKN

SEQ ID NO: 5669 - protein, 10 aa, unidentified
  REGION 1..10: note = Description of Unknown:uncultivated organism
  REGION 1..10: note = MG15 motif 2
YSRACERAGY

SEQ ID NO: 5670 - protein, 8 aa, unidentified
  REGION 1..8: note = Description of Unknown:uncultivated organism
  REGION 1..8: note = MG15 motif 3
VKRSISQT

SEQ ID NO: 5671 - protein, 8 aa, unidentified
  REGION 1..8: note = Description of Unknown:uncultivated organism
  REGION 1..8: note = MG15 motif 4
VKRAISQT

SEQ ID NO: 5672 - protein, 13 aa, unidentified
  REGION 1..13: note = Description of Unknown:uncultivated organism
  REGION 1..13: note = MG15 motif 5
  MOD_RES 9: note = Any amino acid
  MOD_RES 12: note = Any amino acid
KACYKILPXLEXG

SEQ ID NO: 5673 - protein, 13 aa, unidentified
  REGION 1..13: note = Description of Unknown:uncultivated organism
  REGION 1..13: note = MG15 motif 6
  MOD_RES 9: note = Any amino acid
  MOD_RES 12: note = Any amino acid
KACYKLLPXLEXG

SEQ ID NO: 5674 - protein, 8 aa, unidentified
  REGION 1..8: note = Description of Unknown:uncultivated organism
  REGION 1..8: note = MG15, MG21 motif 1
  MOD_RES 6: note = Any amino acid
QKLIPXLE

SEQ ID NO: 5675 - protein, 8 aa, unidentified
  REGION 1..8: note = Description of Unknown:uncultivated organism
  REGION 1..8: note = MG15, MG21 motif 2
  MOD_RES 6: note = Any amino acid
RKLIPXLE

SEQ ID NO: 5676 - protein, 16 aa, unidentified
  REGION 1..16: note = Description of Unknown:uncultivated organism
  REGION 1..16: note = MG16 motif 1
  MOD_RES 2..4: note = Any amino acid
  MOD_RES 7..8: note = Any amino acid
  MOD_RES 11..12: note = Any amino acid
WXXXKAXXKGXXGNTT

SEQ ID NO: 5677 - protein, 16 aa, unidentified
  REGION 1..16: note = Description of Unknown:uncultivated organism
  REGION 1..16: note = MG16 motif 2
  MOD_RES 2..4: note = Any amino acid
  MOD_RES 7..8: note = Any amino acid
  MOD_RES 11..12: note = Any amino acid
WXXXKAXXKGXXGNAT

SEQ ID NO: 5678 - protein, 16 aa, unidentified
  REGION 1..16: note = Description of Unknown:uncultivated organism
  REGION 1..16: note = MG16 motif 3
  MOD_RES 2..4: note = Any amino acid
  MOD_RES 7..8: note = Any amino acid
  MOD_RES 11..12: note = Any amino acid
WXXXRAXXKGXXGNTT

SEQ ID NO: 5679 - protein, 14 aa, unidentified
  REGION 1..14: note = Description of Unknown:uncultivated organism
  REGION 1..14: note = MG18 motif 1
WITLFCDEKKMLVT

SEQ ID NO: 5680 - protein, 11 aa, unidentified
  REGION 1..11: note = Description of Unknown:uncultivated organism
  REGION 1..11: note = MG18 motif 2
HTNKNFMELLS

SEQ ID NO: 5681 - protein, 11 aa, unidentified
  REGION 1..11: note = Description of Unknown:uncultivated organism
  REGION 1..11: note = MG18 motif 3
HTNKNLMELLS

SEQ ID NO: 5682 - protein, 20 aa, unidentified
  REGION 1..20: note = Description of Unknown:uncultivated organism
  REGION 1..20: note = MG18 motif 4
IKAIKKLKYKDWGRLSATLL

SEQ ID NO: 5683 - protein, 21 aa, unidentified
  REGION 1..21: note = Description of Unknown:uncultivated organism
  REGION 1..21: note = MG18 motif 5
CTYLVGEDVLPKESLLYSEFM

SEQ ID NO: 5684 - protein, 18 aa, unidentified
  REGION 1..18: note = Description of Unknown:uncultivated organism
  REGION 1..18: note = MG18 motif 6
TVDGERLPVDVLEKIFKQ

SEQ ID NO: 5685 - protein, 17 aa, unidentified
  REGION 1..17: note = Description of Unknown:uncultivated organism
  REGION 1..17: note = MG18 motif 7
  MOD_RES 11: note = Any amino acid
EQGRCWVVRKXEKIYPW

SEQ ID NO: 5686 - protein, 11 aa, unidentified
  REGION 1..11: note = Description of Unknown:uncultivated organism
  REGION 1..11: note = MG18 motif 8
QNIGGIDDKIN

SEQ ID NO: 5687 - protein, 10 aa, unidentified
  REGION 1..10: note = Description of Unknown:uncultivated organism
  REGION 1..10: note = MG21 motif 1
  MOD_RES 4..5: note = Any amino acid
  MOD_RES 7: note = Any amino acid
SYHXXRXALD

SEQ ID NO: 5688 - protein, 22 aa, unidentified
  REGION 1..22: note = Description of Unknown:uncultivated organism
  REGION 1..22: note = MG21 motif 2
  MOD_RES 5: note = Any amino acid
  MOD_RES 11: note = Any amino acid
  MOD_RES 15: note = Any amino acid
  MOD_RES 19..21: note = Any amino acid
NPVVXRAVSQXIKVXNAVXXXY

SEQ ID NO: 5689 - protein, 20 aa, unidentified
  REGION 1..20: note = Description of Unknown:uncultivated organism
  REGION 1..20: note = MG21 motif 3
  MOD_RES 5..6: note = Any amino acid
  MOD_RES 8: note = Any amino acid
  MOD_RES 11: note = Any amino acid
  MOD_RES 14: note = Any amino acid
  MOD_RES 17: note = Any amino acid
CTFEXXEXRAXKAXYTXEYF

SEQ ID NO: 5690 - protein, 14 aa, unidentified
  REGION 1..14: note = Description of Unknown:uncultivated organism
  REGION 1..14: note = MG21 motif 4
  MOD_RES 3: note = Any amino acid
  MOD_RES 6..7: note = Any amino acid
  MOD_RES 10: note = Any amino acid
YDXACXXVYXDHRG

SEQ ID NO: 5691 - protein, 14 aa, unidentified
  REGION 1..14: note = Description of Unknown:uncultivated organism
  REGION 1..14: note = MG21 motif 5
  MOD_RES 3: note = Any amino acid
  MOD_RES 6..7: note = Any amino acid
  MOD_RES 10: note = Any amino acid
YDXACXXIYXDHRG

SEQ ID NO: 5692 - protein, 6 aa, unidentified
  REGION 1..6: note = Description of Unknown:uncultivated organism
  REGION 1..6: note = MG21 motif 6
KLLQDL

SEQ ID NO: 5693 - protein, 14 aa, unidentified
  REGION 1..14: note = Description of Unknown:uncultivated organism
  REGION 1..14: note = MG21 motif 7
  MOD_RES 2: note = Any amino acid
  MOD_RES 5..6: note = Any amino acid
  MOD_RES 9: note = Any amino acid
  MOD_RES 13: note = Any amino acid
EXAYXXILXSQRXF

SEQ ID NO: 5694 - protein, 11 aa, unidentified
  REGION 1..11: note = Description of Unknown:uncultivated organism
  REGION 1..11: note = MG22 motif 1
  MOD_RES 5: note = Any amino acid
  MOD_RES 8..9: note = Any amino acid
WESPXELXXYI

SEQ ID NO: 5695 - protein, 8 aa, unidentified
  REGION 1..8: note = Description of Unknown:uncultivated organism
  REGION 1..8: note = MG22 motif 2
VEQVSLET

SEQ ID NO: 5696 - protein, 8 aa, unidentified
  REGION 1..8: note = Description of Unknown:uncultivated organism
  REGION 1..8: note = MG22 motif 3
LRVVRDLW

SEQ ID NO: 5697 - protein, 8 aa, unidentified
  REGION 1..8: note = Description of Unknown:uncultivated organism
  REGION 1..8: note = MG22 motif 4
LRVVHDLW

SEQ ID NO: 5698 - protein, 8 aa, unidentified
  REGION 1..8: note = Description of Unknown:uncultivated organism
  REGION 1..8: note = MG22 motif 5
YGAYSKRA

SEQ ID NO: 5699 - protein, 8 aa, unidentified
  REGION 1..8: note = Description of Unknown:uncultivated organism
  REGION 1..8: note = MG22 motif 6
YGAYSDKA

SEQ ID NO: 5700 - protein, 14 aa, unidentified
  REGION 1..14: note = Description of Unknown:uncultivated organism
  REGION 1..14: note = MG23 motif 1
VLKKYDAYDEMFRV

SEQ ID NO: 5701 - protein, 14 aa, unidentified
  REGION 1..14: note = Description of Unknown:uncultivated organism
  REGION 1..14: note = MG23 motif 2
VLKKYNGYDKMFRV

SEQ ID NO: 5702 - protein, 14 aa, unidentified
  REGION 1..14: note = Description of Unknown:uncultivated organism
  REGION 1..14: note = MG23 motif 3
VLKKYDEYDKMFRM

SEQ ID NO: 5703 - protein, 8 aa, unidentified
  REGION 1..8: note = Description of Unknown:uncultivated organism
  REGION 1..8: note = MG23 motif 4
  MOD_RES 6: note = Any amino acid
GKDLWXSR

SEQ ID NO: 5704 - protein, 8 aa, unidentified
  REGION 1..8: note = Description of Unknown:uncultivated organism
  REGION 1..8: note = MG23 motif 5
  MOD_RES 6: note = Any amino acid
GKDFWXSR

SEQ ID NO: 5705 - protein, 16 aa, unidentified
  REGION 1..16: note = Description of Unknown:uncultivated organism
  REGION 1..16: note = MG23 motif 6
  MOD_RES 12: note = Any amino acid
  MOD_RES 14: note = Any amino acid
MVLNELNNLKIXGXKP

SEQ ID NO: 5706 - protein, 16 aa, unidentified
  REGION 1..16: note = Description of Unknown:uncultivated organism
  REGION 1..16: note = MG23 motif 7
  MOD_RES 12: note = Any amino acid
  MOD_RES 14: note = Any amino acid
TVLNELNNLKIXGXKP

SEQ ID NO: 5707 - protein, 16 aa, unidentified
  REGION 1..16: note = Description of Unknown:uncultivated organism
  REGION 1..16: note = MG23 motif 8
  MOD_RES 12: note = Any amino acid
MVLNELNNLRIXGKKP

SEQ ID NO: 5708 - protein, 12 aa, unidentified
  REGION 1..12: note = Description of Unknown:uncultivated organism
  REGION 1..12: note = MG23 motif 9
  MOD_RES 2: note = Any amino acid
  MOD_RES 10: note = Any amino acid
VXVKQGIYEXLF

SEQ ID NO: 5709 - protein, 12 aa, unidentified
  REGION 1..12: note = Description of Unknown:uncultivated organism
  REGION 1..12: note = MG23 motif 10
  MOD_RES 2: note = Any amino acid
  MOD_RES 10: note = Any amino acid
VXVKQDIYEXLF

SEQ ID NO: 5710 - protein, 13 aa, unidentified
  REGION 1..13: note = Description of Unknown:uncultivated organism
  REGION 1..13: note = MG23 motif 11
  MOD_RES 7..8: note = Any amino acid
  MOD_RES 10..11: note = Any amino acid
GKRVTLXXLXXYL

SEQ ID NO: 5711 - protein, 13 aa, unidentified
  REGION 1..13: note = Description of Unknown:uncultivated organism
  REGION 1..13: note = MG23 motif 12
  MOD_RES 7..8: note = Any amino acid
  MOD_RES 10..11: note = Any amino acid
GKKVTLXXLXXYL

SEQ ID NO: 5712 - protein, 8 aa, unidentified
  REGION 1..8: note = Description of Unknown:uncultivated organism
  REGION 1..8: note = MG23 motif 13
  MOD_RES 4: note = Any amino acid
FTDXNQAM

SEQ ID NO: 5713 - protein, 13 aa, unidentified
  REGION 1..13: note = Description of Unknown:uncultivated organism
  REGION 1..13: note = MG23 motif 14
  MOD_RES 7: note = Any amino acid
  MOD_RES 10: note = Any amino acid
WGTVYGXDKXFLK

SEQ ID NO: 5714 - protein, 13 aa, unidentified
  REGION 1..13: note = Description of Unknown:uncultivated organism
  REGION 1..13: note = MG23 motif 15
  MOD_RES 7: note = Any amino acid
  MOD_RES 10: note = Any amino acid
WGTIYGXDKXFLK

SEQ ID NO: 5715 - protein, 13 aa, unidentified
  REGION 1..13: note = Description of Unknown:uncultivated organism
  REGION 1..13: note = MG23 motif 16
  MOD_RES 7: note = Any amino acid
  MOD_RES 10: note = Any amino acid
WATIYGXDKXFLK

SEQ ID NO: 5716 - protein, 8 aa, unidentified
  REGION 1..8: note = Description of Unknown:uncultivated organism
  REGION 1..8: note = MG23 motif 17
ALELLGDE

SEQ ID NO: 5717 - protein, 8 aa, unidentified
  REGION 1..8: note = Description of Unknown:uncultivated organism
  REGION 1..8: note = MG23 motif 18
AKDILGDE

SEQ ID NO: 5718 - protein, 998 aa, unidentified
  REGION 1..998: note = Description of Unknown:uncultivated organism
  REGION 1..998: note = MG40-1 effector
MKKKIFGFDLGIASIGWAVVEFDNEYFDPETGEVVEGKIVKSGVRCFPVAENPKDGSSLAAPRREKRLARRICRRKARRMESIKRLFVAKNLVSDLRELNDLYASQKGGDVWNLRIKGLSEKLSKEELLRVLTHLAKHRGFKSYRKAVEENDAERGRVLKAINENKKLLSKDNTLAQVIVERAGKTGKKRNYTESDAKGMAKAIYNNSIPRNEIERELNLIYAEQKQYGIFSEDLFEDFKKIAFRYRPLGSVADMVGNCTFEKGEKRAPKEAPSSEFFVAWGKINNMAVYENAQKRFLSMEEKKALFELLKTTPKVKYQTIAKKIFVGKDIQFADVNYNLIRKKSKDGSSKEVNPEDAVFYEMKGWHKLKSLFEKDAWSEISKDISLLDRVVNVVVCEKNDENIIKGLKHINVPEKYIETFSSLTTDKFINLSLNALYKILPYMVQGMKYNEACEKAGYDFREKTDKLVEKKGVLLSVIPAEKQTKVPVVNRTISQFRKVYNAMVRQFGAPDQINIETGRELKKNYEERRKIINKNKENEQERKEAEEELRQENIKETSKNIWKYRLYQEQDGKCIYSGKSIDLRRLDEEGYLDVDHIIPYSRSLDDSFNNKVLCLSSENRMKGNKTPFEYIQNKDDWEAFEARVNLLRNNRKKENLLNKNFNDRELEFKERNANDNNYIAKYIKQYLEDGLDFSSSNRQDIKNRIQMRTGSLTSYLRHCWGLHKDRNENDRHHAQDAIVIACATQGMVKYLSTVSGLWENKWQVAQLKDNGEAWYKSLKYKFLEPWNGFREDVKQSLDEIFVSRPPRKSATGEIHQETIRSLNPKHKNYNKKDIKSGILVRGGLANNGSMLRTDVFVKKNKKGKDEFYLVPIYLSDMGKELPSKAIVPLKFEDEWLQIDDNFSFKFSLYMDDLVKVKKGEKEIFGYFKGTGRTTGSITIEAPDRSIITPSIGVKTQDAFKKYSVDPLGNYTEVKHESRIPLTLIKSNAQRYKEQQKG

SEQ ID NO: 5719 - protein, 987 aa, unidentified
  REGION 1..987: note = Description of Unknown:uncultivated organism
  REGION 1..987: note = MG40-2 effector
MKKKKIFGFDLGIASIGWAVVEFDNEYFNPETGEVIEGRILGAGVRTFPQAENHKDGSSLAQPRREHRLARRLCRRKARRLEGIKKMFIAKGLFNSMDDYKSLFEEKGREDVWNLRIEALSRALSKKELMRVLIHLAKHRGFKSYRKAIEEKDEEGGKMLKAIGANKALLSESKTLAQIIVERAGERGKKRNYTHKNDKGKDETVYINSIPRTEIERELDLIYQNQKQYGIFTEDLYNDFKNIAFRFKPFDAVGDMVGYCSFEKNEKRAPKNAPSAEIFVALSKINNLTVYENNTKRFLDDDERANLLQLLKTTQKVKYSSIAKKVFKGKEIKFTDINYAISAKEAKPSNPEDKLFYEMKGWHNIKSYLSEDEWEKYSQNLPLLDNIVTVIATEKNDVKITEALKKLSLDDVIITKFLQLDFDKFINLSLRALYKILPYMEKGLTYNKACASCGYDFKNVAEIVEKGKDGLLLSIPQDKQTTVPVVNRTVSQFRKVYNAMVRHFGIPDQINIETGRELKKSFDERQKIIRKNKENEEERKEAFAKLNENNIQETSTNVLKWRLYQEQDGKCIYSGKPIDLNRLDEVGYLEIDHILPYSRSLDNSYNNKVLCLSAENQMKSNKTPFEYLGGDEEVWNAFCCRINSMQAMRSRKKGNLLVKNYNDRELEFRERNANDNSYISRFVKKYLEDGVDFSQSTRQDIKCRVQTRTGFLTDYLRHCWGLQKNRDESDTHHAQDAVVIACATQEMVTYLSSVSNFKENKWFLTQQKGEAWYKSLKHKFDEPWSGFRNDVATTLEGIFVSRPPRKNATGEIHEETIRPLNPKHKNYNAQKIKSGMSVRGGWASNGGFLRTDVFSKKNKKGKEEFYLVPIYLSDMGKDLPNKAIVPLKDEKEWLTLDDSFEFKFSLYMDDLVKVIKGNKEIFGYFKGTGRTTGSITIESHDRSIITPSIGVKTQDNIKKYQVDPLGNFTEIKGEKRLSLKSGKNHKE

SEQ ID NO: 5720 - protein, 983 aa, unidentified
  REGION 1..983: note = Description of Unknown:uncultivated organism
  REGION 1..983: note = MG40-3 effector
MSLIFGFDLGIASIGWAAVKISDPTASATDAAAPDKRPAGEILGAGVRCFDQAQNAADRRMVRGARRRIRHRAQRMREIRAILRKYNLIDIPEPKSNGKNNFYLNRDTDINIWQLRAVDAFTRKLTPRETGRILYHLAKHRGYDDITYPVSADTKSEKADNADAKEELKAIGEIKRNLAKLHNENPNQTMCQMLYAINHSQHIKMRNGRKSGTKIAKDGTQKTELQSPYSNSIPRSQIKREAEMILRAQRDFGNDFSNVFTKWFDVAFRQRKFNESASPLAKSIEEMRGKCPFTNEPVAPKESPTAQMFVALTKCRQNDFTVEETKKIIDELYKKKTGLKYADVRELLKWDDDRRFKTLNYSRTYDKENKILIEPDIKKIEDRKFYAFTGWHKLAKYTTDIATMDKIFDIIATQKTPENIERAVSEILPEHAAAIAQITSSEFIKLSISALQKIIPEMEKGKKYNEAVAAGLNQDFRAQNVSYINRDDGASAGYLHQINWCLLGNRITSPVAKRTLGQLRKVYNAMVYRFGSPDRIHLEIGRELKNSPDDIARMKREQERNRQATADARKEYGKNYFKYKLYMEQGGKCPYCNATLVAGDWAAYEIDHILPYSRSLDNSQSNKVLVCHECNQRKGSKTPYEFLTSEQFFDMTVRARALHNPAKFKKLTNTDLPQSNDDQNGFIERNANDNATIAKFAAEYLEYGIDWSASDDIKKRVLVRTGSLTDYLRHQWGLVKNRDESDRHHAQDAIVIACATQGMVKYLSTLSARFENKYALIQKNGQAWYNALKTSIQEPWDGFRTDVISCLGNVIVSRPPRCNATGAAHDETIYADPKSYRSKRGMNKNRDKGSLEIRHGRAVRGNMFRFDIWRNARGKYVCVPIFVTDTKGKDDDAFKIPDGEFVCSLHKDDYVRLTTADGMYEGYITQMDHGRNFILYRQDNSKNIVVTKAVGKCTNIEKFAVSLLGTPKPIKLPEQRTPVVKRK

SEQ ID NO: 5721 - protein, 980 aa, unidentified
  REGION 1..980: note = Description of Unknown:uncultivated organism
  REGION 1..980: note = MG40-4 effector
MSLIFGFDLGIASIGWAAVRMSDPTASTTDASAPDSRPVGEIVGAGVRCFDQAQNAADRRTARGARRRIRHRAQRMREIRDILRQYHLIDIPEPKSDGQNNFYLNRDTDINIWQLRAVDAFTRKLTPRETGRILYHLAKHRGYDDITYPVPAGAKSEKADDAESKEELKAIGAIKDNLAKLQRENPDQTMCQMLYATEHAQMRNGRKSVVKIAKDGTQKTEVQSTYSSSIPRSEIKREAEMILHAQRDFGNDFSDAFEKWWAVACRQRKFNESASPLAKSIAEMRGKCPFTNEPVAPKESPTAQKFVALTKCRQNDFTVAETQTVIDELYKKKTGLKYADVRNLLKWDDDKQFKTLNYSRIYDKENKVWIEPDIKKIECQKFYAFTGWHKLAKYTTDIDTMDKIFDVIATQKTPENIERAVSEILPEHAAAIAQITSSEFIKLSISALQKIIPEMENGKKYNEAVASGLNKDFRAQNVSYINRDDGAPAGHLHQINWTLLGNRITSPVAKRTLVQLRKVYNAMVYRFGAPDRIHLEIGRELKNSPDDIARMNREQERNRQATEEARKEYGKNYFKYKLYMEQGGKCPYCNAVLAAGDWGAYEIDHILPYSRSLDNSQSNRVLVCHECNQRKGSKTPYEFLTSEQFYDMTVRARALHNPAKFKKLTNTDLPKCDAEQNGFIERNANDNATIAKFATEYLEYGIDWPASDDIKKRVLVRTGSLTDYLRHQWGLVKNRDESDKHHAQDAIVIACATQGMVKYLSTLSARFENKYALIQKYGQAWYTALKTSIQEPWNGFRTDVISCLNDIIVSRPPRCNATGAAHDETIYADPKSYRSKRGLNKNRDKGSLEIRHGRAVRGDMFRFDIWRNAHGKYVCVPIFVTDTKGKDDDVFKVPDGEFVCSLHKDDYVRLTAADGVYEGYITKMDHGTNFILYRQDNNRTQVVKKSVGKCTNIEKFAVSLLGTPKPIKLPEQRTPVVKRK

SEQ ID NO: 5722 - protein, 997 aa, unidentified
  REGION 1..997: note = Description of Unknown:uncultivated organism
  REGION 1..997: note = MG40-5 effector
MSLIFGFDLGIASIGWAAVKMSDPTASDTDAAAPDNRPVGEILGAGVRCFDQAQNAADRRVARGARRRIRHRAQRMRDIRKILRQYNLIDIPEPKFNGQNNFYLNRDTDINIWQLRAVDAFTRKLTPRETGRILYHLAKHRGYDDITYPVLTGAVPEKADDAEAKEELKAIGAIKDNFAKLHNENPDQTMCQMLYATEHGQMRNGRKSVIKITKDGTQRTEEQSSYSNSIPRSEIKREAEMILHAQCGFGNDFSDVFKEWCVVAFHQLKFNESKSPLAKSIEKMRGKCPFTNKPVAPKESPTAQMFVALTKCRQNGFTVAETNAIIDALYKKKTGLKYADVRKLLKWDDDSQFKTLNYSRTYDKENKKWIEPDVKKIENSKFYAFTGWHKLAKYTTDVATMDKIFDIIVTQKTPENIERAVSGILPEHAAAIAQITSSEFIKLSITALQKIIPEMAAGKKYNEAVADGLGKDFRVQNVSYIDRDDGVSAGCLHQINWNALGNRITSPVAKRTLGQLRKVYNAMVYRFGAPDRIHLEIGRELKNSPDDIARMNREQERNRQATEEARKEYGKNYFKYKLYMEQGGKCPYCGATLVAGDWAAYEIDHILPYSRSLDNSQSNKVLVCHECNQRKGNKTPYEFLTTEQFHDMAVRARALHNPAKFKKLTNTELPQSSDEQNGFIERNANDNATIARFATEYLEYGIDWPESDNIKKRVLVRTGSLTDYLRHQWGLVKNRDESDKHHAQDAIVIACATQGMVKYLSTLSARFENKYALIEKYGQAWYNVLKTSVQEPWAGFRTAVFSLLDNIIVSRPPRCNATGAAHKETIYANPKSYRSKRGLNKNRDKGSMKIRHGRVERGDMFRFDIWRDARGKYVCVPIFVADTKGKDDNNFKVPDGEFICSLHKDDYVRIYTSNQVIEGYISQMQEVIHGDKIYRYLALYTHDNHKTIVCKDDKSKAVPEIFRANVSDATNIEKFAMSLLGTPKPIKLPEQRTPVVK

SEQ ID NO: 5723 - protein, 978 aa, unidentified
  REGION 1..978: note = Description of Unknown:uncultivated organism
  REGION 1..978: note = MG40-6 effector
MSLIFGFDLGIASIGWAAVKMSDPTASDTDAAAPDNRPVGEILGAGVRCFDQAQNAVDRRVARGARRRIRHRAQRMRDIRKILRQYNLIDIPEPKFNGQNNFYLNRDTDINIWQLRAVDAFTRKLTPRETGRILYHLAKHRGYDDITYPVLTGVVPEKADDAETKEELKAIGAIKDNFAKLHNENPDQTMCQMLYATEHGQMRNGRKSVIKITKDGTQRTEEQSSYSNSIPRSEIKREAEMILHAQCGFGNDFSDVFKEWCVVAFHQLKFNESKSPLAKSIEKMRGKCPFTNKPVAPKESPTAQMFVALTKCRQNGFTVAETNAIIDALYKKKTGLKYADVRKLLKWDDDSQFKTLNYSRTYDKENKKWIEPDVKKIENSKFYAFTGWHKLAKYTTDVATMDKIFDIIVTQKTPENIERAVSGILPEHAAAIAQITSSEFIKLSITALQKIIPEMAAGKKYNEAVADGLGKDFRVQNVSYIDRDDGVSAGCLHQINWNALGNRITSPVAKRTLGQLRKVYNAMVYRFGAPDRIHLEIGRELKNSPDDIARMNREQERNRQATEEARKEYGKNYFKYKLYMEQGGKCPYCGATLVAGDWAAYEIDHILPYSRSLDNSQSNKVLVCHECNQRKGNKTPYEFLTTEQFHDMAVRARALHNPAKFKKLTNTELPQSSDEQNGFIERNANDNATIARFATEYLEYGIDWPESDNIKKRVLVRTGSLTDYLRHQWGLVKNRDESDKHHAQDAIVIACATQGMVKYLSTLSARFENKYALIEKYGQAWYNVLKTSVQEPWAGFRTAVFALLDNIIVSRPPRCNATGAAHKETIYANPKSYRSKRGLNKNRDKGSMKIRHGRVERGDMFRFDIWRDARGKYMCVPIFVADTKGKDDNNFKVPDSEFICSLHKDDYVRLTTADGVYEGYITQMDHGTNFILYRQDNSQIQVVKKSVGKCTNIEKFAMSLLGTPKPIKLPEQRTPVVK

SEQ ID NO: 5724 - protein, 984 aa, unidentified
  REGION 1..984: note = Description of Unknown:uncultivated organism
  REGION 1..984: note = MG40-7 effector
MGWAVVDFDDVGDPENEIYPSGEIKKSGVRCFPIAENPKDGSSLAEPRRQKRLMRRLCRRKARRMKGIKALFVANHLVDESELSQENKENIYRVKGNPDVWKLRVKALAEKLTIVEFLRVLTHLAKHRGFKSYRIAAEKADAENGKVLEAIKANKVLLADGKTLAQMLVEKGGKKRNRQKIIIKNGKEGTQPNYEDSIPRDEIIRETDLIFETQRRLGLSFATEKFQSDFKDIAFRYRSVAGIEKMLGSCLFEKEENGKPCKRAPKAAPSAEFFVAWTKINNCAVFEKGEKRFLTAEERLAIFNLLKEQKEVKYAAIRKKIFAGRDDITFADVEYNPKPIVNKRTGEIKEPKKPEDNPFFALKGYHALKNVIDISAYPIEILDQIVSVIATQKNDEAIAGSLKNIGLSETEIEKLQGLTFKTFIKLSLKALYKILPEMQAGKKYNEACKAVGYDFQTTGESFTKEKGKFLPPIPQDMMTTVPAVNRALAQFRKVYNAMVREFGTPDQINIELARDVYNDHDERQEIVKKQQEYAEEKENAKQLAYEKLGLSKISGTQLLKFRLYEQQNGKCVYSGRTLDINRLIDQDYCDVDHIIPYSRSLDNSLHNKVLCLSRENREKTDKTPFEYFRDSKTPAAWEEFKIRVCSMKALSKSKKVRLLAQDFKDREEEFRSRNINDTRYMSRYLMKYLDDCIDFSGSQTDVKDHVQSRNGALTDYLRHQWGLTKKRAENDRHHAQDAIVIACATNGYTQYLARLSKIFENKQAYAAKHGEAWYKAFKAHLKTPWETFYEDVQKSLSEIFVSRPPRKNATGEVHQETIRTLNPDKKGYSEKDVKSGVKVRGGLANNGNMLRVDVFSKKNAKGKEQFYLVPIYLADMVKPEMPNKAIVANKPESDWPVMDDTFIFKFSLFKDDVVKVDDGVFGYYVGTHRGTSAITIEAPDRSETWAGLGARNLKYIKKYQVDPLGRYVEVKSETRVPLNAKQRG

SEQ ID NO: 5725 - protein, 1004 aa, unidentified
  REGION 1..1004: note = Description of Unknown:uncultivated organism
  REGION 1..1004: note = MG40-8 effector
MKKKIFGFDLGIASIGWAVVEFDNEYFNPETGEVIAGKIIRSGVRCFPVAENPKDGSSLAVPRREKRLARRICRRRARRLEGLKKLFVIKHLAENLQEIEELYRLQTGGDVWELRIKGLTEKLSKEELLRVLTHLAKHRGFKSYRKEAEKNDAEGEKILKAINENKQQLEGNKTLAQLIVGRAGKCGKKRNYTELDAKGVEKAVYNNSIPRDEIERELALIYENQKQYGIFSKDLFDDFRKIAFRYRPIGSVADMVGYCTFEKGEKRAPKEAPSSEFFVAWGKINNLAVYENGQKRFLSQEEKLALFELLKSTQKVKYQMISKKIFPQRDIQFADINYNQTAKKAKDGSIKKINPEDVLFYEMKGWHKLKSLFEKDEWAELILNIPLLDEVVNIIACEKNDENITKGLKAINIPEKYFEKFTALTTDKFINLSLKALYNLVPFMKQGLKYNEACEKAGYDFKENNDKLVEKRSVLLEVIPVEKQTKIPVVNRTVAQFRKVYNAMVRQFGAPDQINIETGRELKKSYDERRKIIAKNKENEQERNEAREALENENLKGNSKNILKYRLYQEQDGKCIYSGNPIDLYRLDEEGYLDVDHIIPYSRSLDDSLNNKVLCLSSENRKKGNRTPFEYILDEKDWEMFESRVKLLRNNRKKENLLNMNFVDRELEFRERNANDNNYISRYIKKYLEDGIDFSSSNCQNIKNRIQMRTGSLTSYLRHCWGLKKNRNENDRHHAQDAIVIACATQGMVQYLSAVSGLWENKWEVAQAKENGEAWYKSLKYKFSEPWHGFRDEVEKSLQDIFVSRPPRKSASGEIHQETIRSLNPKHKNYSEKDIKSGIPVRGGLANNGSMLRTDVFVKKNKKGKDEFYLVPIYLSDMRKELPNKAVVPLKFEDEWVQLDDSYTFKFSLYMDDLVKVKKGDNEAIFGYFKGTNRCTGAITIEAADRSKKYDGVGVKTQDSFRKYSVDPLGDITEIKHETRMPLTHVKPNAQGYKKKQEKRLLKG

SEQ ID NO: 5726 - protein, 1014 aa, unidentified
  REGION 1..1014: note = Description of Unknown:uncultivated organism
  REGION 1..1014: note = MG40-9 effector
MKKRIFGFDLGIASIGWAIVEMEDERKNPSDGFLTEGKIVKSGVRIFNVAENPKNGESLAKPRRDKRLSRRLCRRKARRKEAIRNLLIAKGLIGKEDIDRVFMQQVGGDVWDLRVKGLSKKLEKEELARVIFHLGKHRGFKSYRKAEEENDEENGKVLKAIKENREALGKDETKTLAQVIVERAKNSEDKHKRNYQKIIDKNGKKTTELVYLNSIPRSEIKRELKLIYENQKQYGFFTEDLYVALAGKGKEPKDDDNSENGIMFRHRPVGAIDEMVGYCRFETKEKRAPKEAPSSELFVALSKINNMSVYEDNEKRFLNNDERSLLLDLLKKTKTVKYSTISSKIFKEKNIKFADINYRKTVKKDKDGKETKVNPEDEKFYSMSGWHKLKTALGDAFDKYQENIHLLDKIVEITAMYKNDELIQKKFEELNIDKKDAELFKELTFKQFINLSLKALYKIVPYMEQGDKYNEACEKAGYDFRDSGEKLVANKGSVLEVIKPEMMTTVPVVNRAVAQFRKVYNAMVRRYGEPDQINLEVGRELKKSWDERKKTEKMQKENALKREQAKKEIEENEAEATSKNILKYRLYQQQDGKCIYSGKVIDINRLYEDGYAEIDHIIPYSRSLDNSQNNKVLCLSEENRMKGNKTPYEYMKDSGRWHDFKVMVGSLYGIGKRKKDNLLNEGFKNREEEFRERNANDNSHIARYVKQYLNDGISFENSSYKNIKNRIQSRSGSLTDYLRHQWGLEKVRSAGDKHHAQDAIVIACATQGMVQYLSGMAGIFENKYALRGENGEAWYNAIKSNVQEPWKGFRNDVEESLSKVFVSRAVRKNASGEIHEETIRTLNPKHKNYNESDVKSGMHIRGGLANNGVMLRTDVFSKKNKKGKNEFYLVPIYLGDMANDELPNKAIIAGKNEEEWMKIDETCTFLFSLYKNDLIRIRKKEVDIFGYFGGTDRSLGRIIIQEHDRSKDEIRACVKTQDIFKKYQVDPLGFYTEVKTEKRMPLKIKKKTKKCRGE

SEQ ID NO: 5727 - protein, 1010 aa, unidentified
  REGION 1..1010: note = Description of Unknown:uncultivated organism
  REGION 1..1010: note = MG40-10 effector
MKKRVFGFDVGISSLGWAVIDMDDDKDPEKQEEITGEIIAAGVRTFPEAENPKDGKSLAMPRRQKRLARRVCRRKALRKKDLKKLFVEKGLVGETDFVRKNVPLADVWDLRVQGLSRRLSGEELARVLLHLAKHRGFKSYRKAQEKEEEGGKVLEALSKNKALLSENENKTLAQIFVERGGKKRNFCRTVTKNGTEKTEACFDNLFTREEIIREAGLIFDRQRTFGSEFASPEFEEAFGEIAFRHREVDVQGVEKMLGVCPFEKDEKRAPKEAPSAEFFVALGKINSMSVLEGGRKRPLTEGERAALFDLLKARKKVTYRDIRQKVFNSPSEDDFRFSDVEYNPRPKYDKKTKELIVNKKAPEEKEFYSLKGYHALKGLIGEAYDIPTQDKIVSVIAIQKNDKNIEGQLKELGIHPDDIETLKGVSFSKFIGLSLKAVYRLLPEMEAGKKYNEACKAVGYDFKSTGEPFSREKGPFLPPIPQKLLTRVPVVNRAVSQFRKVYNAMVRTYGTPDQINVEMGRDIYNNAQDRKKIQKAQEEFRELKDAARQKAEERLGYGNVSLKVLLKFRLYEEQDGKSVYSGRSIDLDRLAKEPDYCDVDHIIPYSRSLDDSLNNKVLCFSSENREKSNRTPLEYLPVESHADFIGRVMSMKGIKSAKRDRLLIENFSAKEAEFRERNINDTRYMAKYLIKYLDDCIDFSGSSAILKDRVQSRSGGLTDFLRYQWGLKKDRSENDLHHAQDAIVIACATNGYTKYLAHLSKIFENKQRYAEKYGEAWYKAFKRHLKAPWDGFYEDVQKALAKIFVSRSPRKNATGELHKETICTLKPSSGKFKEENVKSGFKIRGGIAGNGEMLRVDVFSKKNKRGKEEYYLVPVYLKDMAAKVLPNKAVVAGKPEEEWLEMDESYVFKFSLFPDDLCFVQKGEKIIFGYYKGANRATASITLEGHDRSFMKEGIGVKTQDRIKKFQVDPLGRYVEVKSEKRLPLKPKSAEQRRRDRWKNDFYKKHPDTK

SEQ ID NO: 5728 - protein, 1010 aa, unidentified
  REGION 1..1010: note = Description of Unknown:uncultivated organism
  REGION 1..1010: note = MG40-11 effector
MKKRVFGFDVGISSLGWAVVDIDDDKDPEKQEEITGEIIAAGVRTFPEAENPKDGKSLAMPRRQKRLARRVCRRKALRKKDLKKLFVEKGLVGETDFVRKNVPLADVWDLRVQGLSRRLSGEELARVLLHLAKHRGFKSYRKAQEKEEEGGKVLEALSKNKALLSENENKTLAQIFVERGGKKRNFCRTVTKNGTEKTEACFDNLFTREEIIREAGLIFDRQRTFGSEFASPEFEEAFGEIAFRHREVDVQGVEKMLGVCPFEKDEKRAPKEAPSAEFFVALGKINSMSVLEGGRKRPLTEGERAALFDLLKARKKVTYRDIRQKVFNSPSEDDFRFSDVEYNPRPKYDKKTKELIVNKKAPEEKEFYSLKGYHALKGLIGEAYDIPTQDKIVSVIAIQKNDKNIEGQLKELGIHPDDIETLKGVSFSKFIGLSLKAVYRLLPEMEAGKKYNEACKAVGYDFKSTGEPFSREKGRFLPPIPQKLLTRVPVVNRAVSQFRKVYNAMVRAYGTPDQINVEMGRDIYNNAQDRKKIQKAQEEFRELKDAARQKAEERLGYGNVSAKVLLKFRLYEEQDGKSVYSGRSIDLHRLANEPDYCDVDHIIPYSRCLDDSLNNKVLCFSSENREKSNRTPLEYLPAESRADFIGRVMSMKGIKSAKRDRLLIENFSAKEAEFRERNINDTRYMAKYLIKYLDDCIDFSGSSAILKDRVQSRSGGLTDFLRYQWGLKKDRSENDLHHAQDAIVIACATNGYTKYLAHLSKIFENKQRYAEKYGEAWYKAFKRHLKAPWDGFYEDVQKALAKIFVSRSPRKNATGEIHKETIYTLKPASGKFKEENVKSGFKIRGGIAGNGEMLRVDVFSKKNKRGKEQYYLVPVYLKDMAAKVLPNKAVVAGKPEEEWLEMDESYVFKFSLFPDDLCFVQKGEKIIFGYYKGANRATASITLEGHDRSFMKEGIGVKTQDRIKKFQVDPLGRYVEVKSEKRLPLKPKSAEQRRRDRWKNDFYKKHPDTK

SEQ ID NO: 5729 - protein, 1001 aa, unidentified
  REGION 1..1001: note = Description of Unknown:uncultivated organism
  REGION 1..1001: note = MG40-12 effector
MKRKVFGFDLGIASIGWSAIEFDNEYFNIDTGEIVEGKILGAGVRTFPVAENPKDGSSLAMPRRSCRAARRLCRRKARRLEGIKKMFVAKGLLNNLDDFTYLFNEKGREDVWNLRVEALKRALSKEELLRVLIHLAKHRGFKSYRKAAEEKDEEGGKVLKAINANKSLLSETKTLAQIIVERAGINGKKRNYKITNEKGKEETVYINSIPRTEIERELDLIFQKQEQYGIFKKDIYQDFKNIAFRFKPFASVGNMVGNCSFEKNEKRASKNAPSAELFVALSKINNLTIYENNAKRFLNTDERLSLLELLKTIQKVKYSTIAKKIFKNKEIKFSDINYAISEKDAKPSNPEDKLFYEMKGWHKIKAILSENEWNEYSHNLPLLDKIVNIIACEKNDEGIVKGLNTLNLSAEIVSKFLQLDFDKFINLSLKALYKILPYMENGMTYDKACNACGYDFKSTVSIVEKGKDGLLKPIPQENQTTVPVVNRTVSQFRKVYNAMVRRYGVPDQINIETGRELKKSFDERKKIEKKNKDNQKEREEVLEKLQQSNIRETSTNVLKWRLYKEQDGKCIYSGKPIDINRLDETGYLEIDHILPYSRSLDDSYDNKVLCFSVENQKKSNKTPFEYLGNYVETWDDFCCRVNSMHAMRSHKKANLLIKNYNDKEVEFRERNANDNSYISRFVKQYLEDGVDFSNSFRQDIKNRIQTRTGYLTDYLRHCWGLKKDRDENDRHHAQDAIVIACATQDMVKYLSTVSNFFENKWLLTQEKGEAWYKSLKHKFKEPWSGFREDIAHTLDNIFVSRPPRKKATGSAHKDTISSKTNNISRLDVRKGEAIKEKMFRCDVYLLDKQYKIVPIYAVDLVSRNFHHYVQPYEKIGNEFLEAKEENFLFSLYKDDYIKITTETDVFQGYFNQYNAQSGQIYLGSMDNSKIFKIRDKNEVSGYHLDKEKKIAINTCIKFEKLQIEILGDIYEVKKESERFFQKMKSNAQKYSEKKTAKQIER

SEQ ID NO: 5730 - protein, 1051 aa, unidentified
  REGION 1..1051: note = Description of Unknown:uncultivated organism
  REGION 1..1051: note = MG40-13 effector
MQKIIFGYDLGIASIGWAAIKFDDESFNPDTGEVFEGRILGAGTRCFPVAENPKDGTSLAEPRRMMRLSRRACRRKARRLLGLKQLFVKKGLAESLERIKKIYSQKGKVDVWTLRAEKAFNEELSKDELIRVLIHLAKHRGFKSYRKAVEEQDKEGGKVLSAIKANKALLTDNKTLAQIIVEQAGISGKKRNRAIKDSKGKVKEIIYNNSISRDEIEREVECIFDAQKKYGIFTEELLEDYKNIAFRHRPVGSIADMVGVCRFEKGEKRAPKEAPSSELFVALTKINNLSVIENGNMRQVTDEERKRILEVLKTTKKVTYKTLKSKVFGKDISIKGDTDTKNLIFYEMKGWHQLKSQFDKEQWAELEKDIPLLNKVVEIIACEKNDEKIKEELKKVNISDENIKVFCGYNFSKFIHLSLKAVDKIIPFMMQGDSYDKACEKAGYDFQENVNKLVSKKSKFLEPIPQDQMTTVPVVNRTIAQFRKVYNAMVRRFGVPDQINIETGRDLKKNHDERRKIEQEINQHREERSISADELKNMGMADNAINILKYRLYQEQDGKCIYSGHSIDLNRLDETGYLDVDHIVPYSRSLDNSQTNKVLCLSSENRKKGNKTPYEYFKDLKTMQQWDEFVARVNLLRNYKKKEKLLIENYEERELKFKERNANDNSYIATFVKRYCEEGIDFSLSSRQDIKNRVQVRNGALTDYLRHQWGLQKDRNESDLHHAQDAIVIACATQGMVEKLSRLSSIFENKEKYRERKARELGHEEAEAWYKYIKSTVREPWCNFRNEVLKTLKNIFVSRPPRKKATGSAHKETIYSKRLGKGSLPIRGGMAEKENMFRLDVFKKDNQYYIVPIYVVDLVKKDGFQDAPQPYKYVDGKLVLIDETYQFTFSLFKDDYVEVFTEGEVFKGYINQYSAQTGQLYLGSVDNSTCYKIKTDTFIVDDKILLPNQEHDCVATVKLFDKMKQKMIVACNGKDLELDASLKLNKKGEETKNIQTLIPYIKLAREKKISLPVMQNLKKYQVSPLGDIHEVKQETRLPLSIKKNKGKKANR

SEQ ID NO: 5731 - protein, 1051 aa, unidentified
  REGION 1..1051: note = Description of Unknown:uncultivated organism
  REGION 1..1051: note = MG40-14 effector
MQKIIFGYDLGIASIGWAAIKFDDESFNPDTGEVFEGRILGAGTRCFPVAENPKDGTSLAEPRRMMRLSRRACRRKARRLLGLKQLFVKKGLAESLETIEKIYSQKGKVDVWTLRAEKAFNEELSKDELIRVLIHLAKHRGFKSYRKAVEEQDKEGGKVLSAIKANKALLTDNKTLAQIIVEQAGISGKKRNRAIKDSKGKVKEIIYNNSISRDEIEREVECIFDAQKKYGIFTEELLEDYKNIAFRHRPVGSIADMVGDCRFEKGEKRAPKEAPSSELFVALTKINNLSVIENGNMRQVTDEERKRILEVLKTTKKVTYKTLKSKVFGKDISIKGDTDTKDLIFYEMKGWHQLKSQFDKEQWAELEKDIPLLNKVVEIIACEKNDEKIKEELKKVNISDENIKVFCGYNFSKFIHLSLKAVDKIIPFMMQGDSYDKACEKAGYDFQENVNKLVSKKSKFLEPIPQDQMTTVPVVNRTIAQFRKVYNAMVRRFGVPDQINIETGRDLKKNHDERRKIEQEINQHREERSISADELKNMGMADNAINILKYRLYQEQDGKCIYSGHSIDLNRLDETGYLDVDHIVPYSRSLDNSQTNKVLCLSSENRKKGNKTPYEYFKDLKTMQQWDEFVARVNLLRNYKKKEKLLIENYEERELKFKERNANDNSYIATFVKRYCEEGIDFSLSSRQDIKNRVQVRNGALTDYLRHQWGLQKDRNESDLHHAQDAIVIACATQGMVEKLSRLSSIFENKEKFRERKARELGHEEAEAWYKYIKSTVREPWCNFRNEVLETLKNIFVSRPPRKKATGSAHKETIYSKRLGKGSLPIRGGMAEKENMFRLDVFKKDSQYYIVPIYVVDLVKKDGFQDAPQPYKYVDGKLVLIDETYQFTFSLFKDDYVEVFTEGEVFKGYINQYSAQTGQLYLGSVDNSTCYKIKTDTFIVDDKILLPNQEYDCVATVKLFDKMKQKMIVACNGKDLELDASLKLNKKGEETKNIQTLIPYIKLAREKKISLPVMQNLKKYQVSPLGDIHEVKQETRLPLSIKKNKGKKANR

SEQ ID NO: 5732 - protein, 1012 aa, unidentified
  REGION 1..1012: note = Description of Unknown:uncultivated organism
  REGION 1..1012: note = MG40-15 effector
MRKRIFGFDLGIASIGWAVVDFDKEYFDHETGEVIEGNIVKSGVRCFPVAENPKDGSSLAEPRRLKRLARRICRRKARRMQGIKKLFIAKGLVSNETELADLYKTQRGGDVWNLRIKALSECLSAEELIRVLTHLAKHRGFKSYRKAEEEKDEASGKVLKAIQENLSLLTDNKTLAQVVVEKAGADGKKRNYTVNVKNKKDKKEAVYINSIPRVEIERELKLIFEAQKQYGIFTQDLYDDFCKIAFRYRPAGSVADMVGFCTFEKGERRAPKESPSAELFVALTKINNMSIVDENGNIRKVNQQEREKIIALLKSTKTVKYTTLASKVFAKGVTFRDINYNATQKKTKDGQLKIVNPEDVVFYEMKGWHKLKSQFTDGEWVKFENDTELLDQVVNIIACEKNDENITNKLKAMGLDEESIAKFNNCSFSKFINLSFKALYKIIPHMQEDKENLYNDACKKAGYDYRLSTDKLVDSKGLLLAAIPQDKLTTVPVVNRTVSQFRKVYNALVRQYGLPDQINIEAGRDLKKTFEERKNIKSKNEENMQERKIAAEELSENTIKDTSTNILKYRLYKEQDGKCIYSGRVIDINRLDEIGYLDVDHIIPYSRSLDNSYTNKVLCLSSENRKKGNKTPFEYIIDKNAWDEFEARVKLLHNKRKEDNLLNMTFADRELEFRERNANDNSHIARYVKQYCEDGIDFSSSPWKSIKNRVQVRTGYLTDYLRSQWGLVKNRDENDRHHAQDAIVIACATQEMVSYLSYVSSIFENKYEVQARTGEAWYKSLKDKWREPWIGFRNSVLSSLDEIFVSRPPRKNATGEIHQERIRTINPQFKKKYDAKEIKSGLAVRGGMAANGNMLRTDVFVKKNKKGKDEFYLVPVYLSDMGKELPNKAIVANKDEKEWVKIDESYIFKFSMFMDDLIKVTKGDKVIFGYFSGTHRGNGSITLEDHDRSKINAGIGVKTQDKIQKFAVDPLGKITEIKHETRLPLTNIKSNKQRIADRKVRREKTEQTKEQG

SEQ ID NO: 5733 - protein, 879 aa, unidentified
  REGION 1..879: note = Description of Unknown:uncultivated organism
  REGION 1..879: note = MG40-16 effector
MRKRIFGFDLGIASIGWAVVDFDKEYFDHETGEVIEGNIVKSGVRCFPVAENPKDGSSLAEPRRLKRLARRICRRKARRMQGIKKLFIAKGLVSNETELADLYKTQRGGDVWNLRIKALSECLSVEELIRVLTHLAKHRGFKSYRKAEEEKDEASGKVLKAIQENLSLLTENKTLAQVVVEKAGADGKKRNYTVSVKNKKNEKEAVYVNSIPRVEIERELKLIFEAQKQYGIFTQDLYDDFCKIAFRYRPAGSVADMVGFCTFEKGERRAPKESPSAELFVALTKINNMSIVDENGNIRKVNQQEREKIIALLKSTKTVKYTTLASKVFAKGVTFRDINYNATQKKTKDGKFKIVNPEDVVFYEMKGWHKLKSQFTDGEWVKFENDTELLDQVVNIIACEKNDENITNKLKAMGLDEESIAKFNNCSFSKFINLSFKALYKIIPHMKEDKENLYNDACKKAGYDYRLSTDKLVDSKGLLLAAIPQDKLTTVPVVNRTVSQFRKVYNALVRQYGLPDQINIEAGRDLKKTFEERKNIKSKNEENMQERKIAAEELSENTIKDTSTNILKYRLYKEQDGKCIYSGRVIDINRLDEIGYLDVDHIIPYSRSLDNSYTNKVLCLSSENRKKGNKTPFEYIIDKNAWDEFEARVKLLHNKRKEDNLLNMTFADRELEFRERNANDNSHIARYVKQYCEDGIDFSSSPWKSIKNRVQVRTGYLTDYLRSQWGLVKNRDENDRHHAQDAIVIACATQEMVSYLSYVSSIFENKYEVQARTGEAWYKSLKDKWREPWIGFRNSVLSSLDEIFVSRPPRKNATGEIHQERIRTINPQFKKKYDVKEIKSGLAVRGGMAANGNMLRTDVFVKKNKKGKDEFYLVPVYLS

SEQ ID NO: 5734 - protein, 1015 aa, unidentified
  REGION 1..1015: note = Description of Unknown:uncultivated organism
  REGION 1..1015: note = MG40-17 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDAEGGKVLKAIKANSTQLYDNKTLAQIIVERAGKNGKKRNYTETNAKGKEEAVYINSIPRIEIMRETKLIYEVQKREKGLFTDELYAKFCKIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMKGWHKLKAQFDKDEWAVVSKDTHLLDKVVNMIACEKNDAAITKALKELGVKDEWIEKFNNCTFDKFINLSFKALYNIVPYMMDSLHYNEACEKVGYDHKLTVDKLVEHKGIYLEAIASNKLTKVPVVNRTVAQFRKVYNAMARQYGLPDQINIEMGRDLKKTFDERRNLKNRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMDWAEFEARVKLLHNKKKEDLLLCNDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIEEIFVSRPPRKNATGEIHQERIRTINPNNKKYSEKDVKSGIFIRGGLANNGNMLRTDVFVKKNKKGKEQFYLVPVYLSDMGKELPNKAIVAGKDEKDWLIIDDSYTFKFSLYADDFVRVLKSENIDKDKIEGYFDGTDRSTGSIVLEAHDRSARYRGIGVKSLYKFQKFSVDPLGNITEIKQETRLPLTNIKSNKQRMAERKARREKLEQEKQQQTETL

SEQ ID NO: 5735 - protein, 1011 aa, unidentified
  REGION 1..1011: note = Description of Unknown:uncultivated organism
  REGION 1..1011: note = MG40-18 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDAEGGKVLKAIKANSTQLYDNKTLAQIIVERAGKNGKKRNYTETNAKGKEEAVYINSIPRTEIIRETKLIYEAQKKEKGLFTDELYAKFCKIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDVTFYEMKGWHKLKAQFDKDEWAVVSKDTHLLDKVVNIIACEKNDASITKALKELGVKDEWIEKFNNCTFDKFINLSFKALYNIVPYMMDSLHYNEACEKVGYDHKLTVDKLVEHKGIYLEAISSNKLTKVPVVNRTVAQFRKVYNAMARQYGLPDQINIEMGRDLKRTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKNIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIEEIFVSRPPRKNATGEIHQERIRTINPNNKKYSEKDVKSGIFIRGGLANNGNMLRTDVFVKKNKKGKEQFYLVPVYLSDMGKELPNKAIVQNKDEKDWVIIDDSYTFKFSMFMDDLIKITKGNKAILGYFCGTHRGNASITLEEHDRAKITEGIGVKGLDKFQKFSVDSLGNITEIKQETRLPLTNIKSNKQRMAERKARREKLEQEKQQQTETL

SEQ ID NO: 5736 - protein, 1005 aa, unidentified
  REGION 1..1005: note = Description of Unknown:uncultivated organism
  REGION 1..1005: note = MG40-19 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSIQLSDNKTLAQIIVERAGKNGKKRNYTETNAKGKEEAVYINSIPRIEIMRETKLIYEAQKGEKGLFTDELYAKFCNIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMEGWHKLKAQFDKDEWAVVSKDTHLLDKVVNIIACEKNDASITKALKELGVKDEWIEKFNNCTFDKFINLSFKALYNIVPYMMDGLHYNEACEKVGYDHKLTVDKLVEHKGIYLEAIASDKLTKVPVVNRTVAQFRKVYNAMARQYGLPDQINIEMGRDLKKTFEERKDLKSLQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIDEIFVSRPPRKNATGEIHQERIRTINPNNKKYSEKDVKSGIFIRGGLANNGNMLRTDVFVKKNKKGKEQFYLVPVYLSDMGKELPNKAIVAKKDEKDWVIIDDSYTFKFSMFMDDLIKITKGNKAILGYFCGTHRGNASITLEEHDRAKITEGIGVKGLDKFQKFSVDPLGNITEIKQETRLPLTNIKSNKQRMAERKARREKLEQEKQ

SEQ ID NO: 5737 - protein, 1008 aa, unidentified
  REGION 1..1008: note = Description of Unknown:uncultivated organism
  REGION 1..1008: note = MG40-20 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSIQLSDNKTLAQIIVERAGKNGKKRNYTETNAKGKEEAVYINSIPRIEIMRETKLIYEAQKGEKGLFTDELYAKFCNIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMEGWHKLKAQFDKDEWAVVSKDTHLLDKVVNIIACEKNDASITKALKELGVKDEWIEKFNNCTFDKFINLSFKALYNIVPYMMDGLHYNEACEKVGYDHKLTVDKLVEHKGIYLEAIASDKLTKVPVVNRTVAQFRKVYNAMARQYGLPDQINIEMGRDLKKTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLTKDRNANDRHHAQDAIVIACATQGMVSYLSYVSSVFENKFAVQAKTGEAWYQSLKKKWNEPWTGFRDSVLKSIDEIFVSRPPRKNATGEIHQERIRTINPNNKKYSEKDVKSGIFIRGGLANNGNMLRTDVFVKKNKKGKEQFYLVPVYLSDMGKELPNKAIVPNKDEKDWVIIDDSYTFKFSLYADDFVRVLKSENIDKDKIEGYFDGTDRSTGAIALEAHDRSVRYRGIGVKSLYKFQKFSVDPLGNITEIKQETRLPLTNIKSNKQRMAERKARREKLEQEK

SEQ ID NO: 5738 - protein, 1009 aa, unidentified
  REGION 1..1009: note = Description of Unknown:uncultivated organism
  REGION 1..1009: note = MG40-21 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSIQLSDNKTLAQIIVERAGKNGKKRNYTETNAKGKEEAVYINSIPRIEIMRETKLIYEAQKGEKGLFTDELYAKFCNIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMEGWHKLKAQFDKDEWAVVSKDTHLLDKVVNIIACEKNDASITKALKELGVKDEWIEKFNNCTFDKFINLSFKALYNIVPYMMDGLHYNEACEKVGYDHKLTVDKLVEHKGIYLEAIASDKLTKVPVVNRTVAQFRKVYNAMARQYGLPDQINIEMGRDLKKTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLTKDRNANDRHHAQDAIVIACATQGMVSYLSYVSSVFENKFAVQAKTGEAWYQSLKKKWNEPWTGFRDSVLKSIDEIFVSRPPRKNATGEIHQERIRTINPNNKKYSEKDVKSGIFIRGGLANNGNMLRTDVFVKKNKKGKEQFYLVPVYLSDMGKELPNKAIVPNKDEKDWVIIDDSYTFKFSLYADDFVRVLKSENIDKDKIEGYFDGTDRSTGAIALEAHDRSVRYRGIGVKSLYKFQKFSVDPLGNITEIKQETRLPLTNIKSNKQRMAERKARREKLEQEKQ

SEQ ID NO: 5739 - protein, 776 aa, unidentified
  REGION 1..776: note = Description of Unknown:uncultivated organism
  REGION 1..776: note = MG40-22 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSIQLSDNKTLAQIIVERAGKNGKKRNYTETNAKGKEEAVYINSIPRIEIMRETKLIYEAQKGEKGLFTDELYAKFCNIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMKGWHKLKAQFDKDEWAVVSKDTHLLDKVVNIIACEKNDASITKALKELGVKDEWIEKFNNCTFDKFINLSFKALYNIVPYMMDGLHYNEACEKVGYDHKLTVDKLVEHKGIYLEAIASDKLTKVPVVNRTVAQFRKVYNAMARQYGLPDQINIEMGRDLKKTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQS

SEQ ID NO: 5740 - protein, 1011 aa, unidentified
  REGION 1..1011: note = Description of Unknown:uncultivated organism
  REGION 1..1011: note = MG40-23 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSIQLSDNKTLAQIIVERAGKNGKKRNYTETNAKGKEEAVYINSIPRIEIMRETKLIYEAQKGEKGLFTDELYAKFCNIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMKGWHKLKAQFDKDEWAVVSKDTHLLDKVVNIIACEKNDASITKALKELGVKDEWIEKFNNCTFDKFINLSFKALYNIVPYMMDGLHYNEACEKVGYDHKLTVDKLVEHKGIYLEAIASDKLTKVPVVNRTVAQFRKVYNAMARQYGLPDQINIEMGRDLKKTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIDEIFVSRPPRKNATGEIHQERIRTINPNNKKYSEKDVKSGIFIRGGLANNGNMLRTDVFVKKNKKGKEQFYLVPVYLSDMGKELPNKAIVQNKDEKDWVIIDDSYTFKFSMFMDDLIKITKGNKAILGYFCGTHRGNASITLEEHDRAKITEGIGVKGLDKFQKFSVDSLGNITEIKQETRLPLTNIKSNKQRMAERKARREKLEQEKQQQTEIL

SEQ ID NO: 5741 - protein, 909 aa, unidentified
  REGION 1..909: note = Description of Unknown:uncultivated organism
  REGION 1..909: note = MG40-24 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSIQLSDNKTLAQIIVERAGKNGKKRNYTETNAKGKEEAVYINSIPRIEIMRETKLIYEAQKGEKGLFTDELYAKFCNIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMKGWHKLKAQFDKDEWAVVSKDTHLLDKVVSIIACEKNDVSITKALKELGVNDEWIAKFNKCTFDKFINLSFKALYNIVPYMMDGLHYNEACEKACYDHRLTVDKLVEHKGIYLEAIASNKLTKVPVVNRTVAQFRKVYNAMARQYGLPDQINIEMGRDLKKTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIDEIFVSRPPRKNATGEIHQERIRTINPNNKKYSEKDVKSGIFIRGGLANNGNMLRTDVFVKKNKKGKEQFYLVPVYLSDMGKELPNKAIVAKKDEKDWVIIDDSYTFKFSMFM

SEQ ID NO: 5742 - protein, 1005 aa, unidentified
  REGION 1..1005: note = Description of Unknown:uncultivated organism
  REGION 1..1005: note = MG40-25 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSIQLSDNKTLAQIIVERAGKNGKKRNYTETNAKGKEEAVYINSIPRIEIMRETKLIYEAQKGEKGLFTDELYAKFCNIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMKGWHKLKAQFDKDEWAVVSKDTHLLDKVVSIIACEKNDVSITKALKELGVNDEWIAKFNKCTFDKFINLSFKALYNIVPYMMDGLHYNEACEKACYDHRLTVDKLVEHKGIYLEAIASNKLTKVPVVNRTVAQFRKVYNAMARQYGLPDQINIEMGRDLKKTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIDEIFVSRPPRKNATGEIHQERIRTINPNNKKYSEKDVKSGIFIRGGLANNGNMLRTDVFVKKNKKGKEQFYLVPVYLSDMGKELPNKAIVAKKDEKDWVIIDDSYTFKFSMFMDDLIKITKGNKAILGYFCGTHRGNASITLEEHDRAKITEGIGVKGLDKFQKFSVDPLGNITEIKQETRLPLTNIKSNKQRMAERKARREKLEQEKQ

SEQ ID NO: 5743 - protein, 860 aa, unidentified
  REGION 1..860: note = Description of Unknown:uncultivated organism
  REGION 1..860: note = MG40-26 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVVDSDMLQKLYAEQKDGDVWNLRIKALTQKLTAAELVRVLTHLAKHRGFKSYRKAAEESDAEGGKVLKAIKANSTQLDDNKTLAQIIVERAGKNGKKRNYTETNAKGKEEAVYINSIPRTEIIRETKLIYEAQKGKKGLFTDELYAKFCKIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMKGWHKLKAQFDKDEWAVVSKDTHLLDKVVNIIACEKNDAAITKALKELGVKDEWIEKFNNCTFDKFINLSFKALYNIVPYMMDSLHYNEACEKVGYDHKLTVDKLVEHKGIYLEAIASNKLTKVPVVNRTVAQFRKVYNAMARQYGLPDQINIEMGRDLKRTFKERKDLKSLQDENRKQREIIEKELNEKHIKVNAKNILKYRLYKEQSCKCIYSGKTIDLKRLDEVGYLDVDHIIPYSRSFDDSYNNKVLCLSEENRKKGNKTPFDYIKNEMDWADFEARVKLLHNKKKEDLLLCNDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIEEIFVSRPPRKNATGEIHQERIRTINPNNKKYSEKDVKSGIFIRGGLANNGNMLRTDVFVKKNK

SEQ ID NO: 5744 - protein, 1015 aa, unidentified
  REGION 1..1015: note = Description of Unknown:uncultivated organism
  REGION 1..1015: note = MG40-27 effector
MRKRIFGFDLGIASIGWAVVDFDKEYFDHETGEVIEGQIIKSGVRCFPVAENPKDGSSLAAPRREKRLARRICRRKARRMQEIKQLFIDSGLVVDSDMLQKLYAEQKDGDVWNLRIKALTQKLTAAELVRVLTHLAKHRGFKSYRKAAEESDAEGGKVLKAIKANSTQLDDNKTLAQIIVERAGKNGKKRNYTETNAKGKEEAVYINSIPRTEIIRETKLIYEAQKGKKGLFTDELYAKFCKIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDITFYEMKGWHKLKAQFDKDEWAVVSKDTHLLDKVVNIIACEKNDAAITKALKELGVKDEWIEKFNNCTFDKFINLSFKALYNIVPYMMDSLHYNEACEKVGYDHRLTVDKLVEHKGIYLEAIASNKLTKVPVVNRTVAQFRKVYNAMARQYGLPDQINIEMGRDLKRTFKERKDLKSLQDENRKQREIIEKELNEKHIKVNAKNILKYRLYKEQSCKCIYSGKTIDLKRLDEVGYLDVDHIIPYSRSFDDSYNNKVLCLSEENRKKGNKTPFDYIKNEMDWADFEARVKLLHNKKKEDLLLCNDFQDRELAFKERNANDNSYISRYVKQYCEDGIDFSSSPWKDIKNRIQMRAGYLTDYLRWQWGLSKDRNANDRHHAQDAIVIACATQGMVSYLSYVSSVFENKFAVQAKTGEAWYQSLKKKWNEPWTGFRDSVLKSIEEIFVSRPPRKNATGEIHQERIRTINPNNKKYSEKDVKSGIFIRGGLANNGNMLRTDVFVKKNKKGKEQFYLVPVYLSDMGKELPNKAIVQNKDEKDWLIIDDSYTFKFSLYADDFVRVLKSENIDKDKIEGYFDGTDRSTGAIALEAHDRSARYRGIGVKSLYKFQKFSVDPLGNITEIKQETRLPLTNIKSNKQRMAERKARREKLEQEKQQQTETL

SEQ ID NO: 5745 - protein, 1005 aa, unidentified
  REGION 1..1005: note = Description of Unknown:uncultivated organism
  REGION 1..1005: note = MG40-28 effector
MRKRIFGFDLGIASIGWAVVDFDKEYFDHETGEVIEGQIIKSGVRCFPVAENPKDGSSLAAPRRKKRLARRICRRKARRMQEIKQLFIDSGLVADSDMLQKLYAEQKDGDVWNLRIKALTQKLTAAELVRVLTHLAKHRGFKSYRKAAEESDTEGGKVLKAIKANSTQLYDNKTLAQIIVERAGKNGKKRNYTETNAKGKEEAVYINSIPRTEIMRETKLIYEVQKREKGLFTDELYAKFCKIAFRYREAGSVANMVGQCIFEKDEKRAPREAPTSELFVALTKINNMSLNDNGKIRTVSPTERKQILEILKNTKLVKYSTLSSKVFAKGVKFRDIDYNKTEKRNKNNEVKTVNPEDVTFYEMKGWHKLKAQFNKDEWTVVSKDTHLLDKVVNIIACEKNDASITKALKELGVKDEWIEKFNNCTFDKFINLSFKALYNIVPYMMDGLHYNEACEKACYDHRLTVDKLVEHKGIYLEAIASDKLTKVPVVNRTVAQFRKVYNAMARQYGLPDQINIEMGRDLKRTFEERKDLKSRQDENMKQREIIEKELNEHKIKVNAKNILKYRLYKEQSCKCIYSGKTIDLERLDEVGYLDVDHIIPYSRSFDDSYNNKVLCLSEENRKKGNKTPFDYIKNEMAWAEFEARVKLLHNKKKEDLLLCKDFQDRELAFKERNANDNSYISRYVKQYCEDGIDFSSSPWKDIKNRIQMRAGYLTDYLRWQWGLTKDRNANDRHHAQDAIVIACATQGMVSYLSYVSSIFENKFAVQAKTGEAWYQSLKKKWNEPWTGFRDSVLKSIDEIFVSRPPRKNATGEIHQERIRTINPNNKKYSEKDVKSGIFIRGGLANNGNMLRTDVFVKKNKKGKEQFYLVPVYLSDMGKELPNKAIVPNKDEKDWVIIDDSYTFKFSMFMDDLIKITKGNKAILGYFCGTHRGNASITLEEHDRAKITEGIGVKGLDKFQKFSVDPLGNRIEIKQETRLPLTNIKSNKQRMAERKARREKLEQEKQ

SEQ ID NO: 5746 - protein, 997 aa, unidentified
  REGION 1..997: note = Description of Unknown:uncultivated organism
  REGION 1..997: note = MG40-29 effector
MSLIFGFDLGIASICWAAVKMSDPTASDTDAAAPDNRPVGEILGAGVRCFDQAQNAVDRRVARGARRRIRHRAQRMRDIRKILRQYNLIDIPEPKFNGQNNFYLNRDTDINIWQLRAVDAFTRKLTPRETGRILYHLAKHRGYDDITYPVLTGVVPEKADDAETKEELKAIGAIKDNFAKLHNENPDQTMCQMLYATEHGQMRNGRKSVIKITKDGTQRTEEQSSYSNSIPRSEIKREAEMILHAQCGFGNDFSDVFKEWCVVAFHQLKFNESKSPLAKSIEKMRGKCPFTNKPVAPKESPTAQMFVALTKCRQNGFTVAETNAIIDALYKKKTGLKYADVRKLLKWDDDSQFKTLNYSRTYDKENKKWIEPDVKKIENSKFYAFTGWHKLAKYTTDVATMDKIFDIIVTQKTPENIERAVSGILPEHAAAIAQITSSEFIKLSITALQKIIPEMAAGKKYNEAVADGLGKDFRVQNVSYIDRDDGVSAGCLHQINWNALGNRITSPVAKRTLGQLRKVYNAMVYRFGAPDRIHLEIGRELKNSPDDIARMNREQERNRQATEEARKEYGKNYFKYKLYMEQGGKCPYCGATLVAGDWAAYEIDHILPYSRSLDNSQSNKVLVCHECNQRKGNKTPYEFLTTEQFHDMAVRARALHNPAKFKKLTNTELPQSSDEQNGFIERNANDNATIARFATEYLEYGIDWPESDNIKKRVLVRTGSLTDYLRHQWGLVKNRDESDKHHAQDAIVIACATQGMVKYLSTLSARFENKYALIEKYGQAWYNVLKTSVQEPWAGFRTAVFSLLDNIIVSRPPRCNATGAAHKETIYANPKSYRSKRGLNKNRDKGSMKIRHGRVERGDMFRFDIWRDARGKYVCVPIFVADTKGKDDNNFKVPDGEFICSLHKDDYVRIYTSNQVIEGYISQMQEVIHGDKIYRYLALYTHDNHKTIVCKDDKSKAVPEIFRANVSDATNIEKFAMSLLGTPKPIKLPEQRTPVVK

SEQ ID NO: 5747 - protein, 978 aa, unidentified
  REGION 1..978: note = Description of Unknown:uncultivated organism
  REGION 1..978: note = MG40-30 effector
MSLIFGFDLGIASIGWAAVKMSDPTASDTDAAAPDNRPVGEILGAGVRCFDQAQNAADRRVARGARRRIRHRAQRMRDIRKILRQYNLIDIPEPKFNGQNNFYLNRDTDINIWQLRAVDAFTRKLTPRETGRILYHLAKHRGYDDITYPVLTGAVPEKADDAEAKEELKAIGAIKDNFAKLKRENPDQTMCQMLYATEHGQMRNGRKSVIKITKDGTQRTEEQSSYSNSIPRSEIKREAEMILHAQCGFGNDFSDVFKEWCVVAFHQLKFNESKSPLAKSIEKMRGKCPFTNKPVAPKESPTAQMFVALTKCRQNGFTVAETNAIIDALYKKKTGLKYADVRKLLKWDDDSQFKTLNYSRTYDKENKKWIEPDVKKIENSKFYAFTGWHKLAKYTTDVATMDKIFDIIVTQKTPENIERAVSGILPEHAAAIAQITSSEFIKLSITALQKIIPEMAAGKKYNEAVADGLGKDFRVQNVSYIDRDDGVSAGCLHQINWNALGNRITSPVAKRTLGQLRKVYNAMVYRFGAPDRIHLEIGRELKNSPDDIARMNREQERNRQATEEARKEYGKNYFKYKLYMEQGGKCPYCGATLVAGDWAAYEIDHILPYSRSLDNSQSNKVLVCHECNQRKGNKTPYEFLTTEQFHDMAVRARALHNPAKFKKLTNTELPQSNDDQNGFIERNANDNATIARFATEYLEYGIDWPESDNIKKRVLVRTGSLTDYLRHQWGLVKNRDESDKHHAQDAIVIACATQGMVKYLSTLSARFENKYALIEKYGQAWYNVLKTSVQEPWTGFRTAVFSLLDNIIVSRPPRCNATGAAHKETIYANPKSYRSKRGLNKNRDKGSMKIRHGRVERGDMFRFDIWRDARGKYMCIPIFVADTKGKDDNNFKVPDSEFICSLHKDDYVRLTTADGVYEGYITQMDHGTNFILYRQDNSQIQVVKKSVGKCTNIEKFAMSLLGTPKPIKLPEQRTPVVK

SEQ ID NO: 5748 - protein, 978 aa, unidentified
  REGION 1..978: note = Description of Unknown:uncultivated organism
  REGION 1..978: note = MG40-31 effector
MSLIFGFDLGIASIGWAAVKMSDPTASDTDAAAPDNRPVGEILGAGVRCFDQAQNAVDRRVARGARRRIRHRAQRMRDIRKILRQYNLIDIPEPKFNGQNNFYLNRDTDINIWQLRAVDAFTRKLTPRETGRILYHLAKHRGYDDITYPVLTGAVPEKADDAEAKEELKAIGAIKDNFAKLHNENPDQTMCQMLYATEHGQMRNGRKSVIKITKDGTQRTEEQSSYSNSIPRSEIKREAEMILHAQCGFGNDFSDVFKKWCVVAFHQLKFNESKSPLAKSIEKMRGKCPFTNKPVAPKESPTAQMFVALTKCRQNGFTVAETNAIIDALYKKKTGLKYADVRKLLKWDDDSQFKTLNYSRTYDKENKKWIEPDVKKIENSKFYAFTGWHKLAKYTTDVATMDKIFDIIVTQKTPENIERAVSGILPEHAAAIAQITSSEFIKLSISALQKIIPEMAAGKKYNEAVADGLGKDFRVQNVSYIDRDNGVSAGCLHQINWNALGNRITSPVAKRTLGQLRKVYNAMVYRFGAPDRIHLEIGRELKNSPDDIARMNREQERNRQATEEARKEYGKNYFKYKLYMEQGGKCPYCGATLVAGDWAAYEIDHILPYSRSLDNSQSNKVLVCHECNQRKGNKTPYEFLTTEQFHDMAVRARALHNPAKFKKLTNTELPQSSDEQNGFIERNANDNATIARFATEYLEYGIDWPESDNIKKRVLVRTGSLTDYLRHQWGLVKNRDESDKHHAQDAIVIACATQGMVKYLSTLSARFENKYTLIEKYGQAWYNVLKTSVQEPWAGFRTAVFSLLDNIIVSRPPRCNATGAAHKETIYANPKSYRSKRGLNKNRDKGSMKIRHGRVERGDMFRFDIWRDARGKYMCVPIFVADTKGKDDNNFKVPDSEFICSLHKDDYVRLTTADAVYEGYITQMDHGTNFILYRQDNSQIQVVKKSVGKCTNIEKFAMSLLGTPKPIKLPEQRTPVVK

SEQ ID NO: 5749 - protein, 997 aa, unidentified
  REGION 1..997: note = Description of Unknown:uncultivated organism
  REGION 1..997: note = MG40-32 effector
MSLIFGFDLGIASIGWAAVKMSDPTASDTDAAAPDNRPVGEILGAGVRCFDQAQNAVDRRVARGARRRIRHRAQRMRDIRKILRQYNLIDIPEPKFNGQNNFYLNRDTDINIWQLRAVDAFTRKLTPRETGRILYHLAKHRGYDDITYPVLTGVVPEKADDAETKEELKAIGAIKDNFAKLHNENPDQTMCQMLYATEHGQMRNGRKSVIKITKDGTQRTEEQSSYSNSIPRSEIKREAEMILHAQCGFGNDFSDVFKEWCVVAFHQLKFNESKSPLAKSIEKMRGKCPFTNKPVAPKESPTAQMFVALTKCRQNGFTVAETNAIIDALYKKKTGLKYADVRKLLKWDDDSQFKTLNYSRTYDKENKKWIEPDVKKIENSKFYAFTGWHKLAKYTTDVATMDKIFDIIVTQKTPENIERAVSGILPEHAAAIAQITSSEFIKLSITALQKIIPEMAAGKKYNEAVADGLGKDFRVQNVSYIDRDDGVSAGCLHQINWNALGNRITSPVAKRTLGQLRKVYNAMVYRFGAPDRIHLEIGRELKNSPDDIARMNREQERNRQATEEARKEYGKNYFKYKLYMEQGGKCPYCGATLVAGDWAAYEIDHILPYSRSLDNSQSNKVLVCHECNQRKGNKTPYEFLTTEQFHDMAVRARALHNPAKFKKLTNTELPQSSDEQNGFIERNANDNATIARFATEYLEYGIDWPESDNIKKRVLVRTGSLTDYLRHQWGLVKNRDESDKHHAQDAIVIACATQGMVKYLSTLSARFENKYALIEKYGQAWYNVLKTSVQEPWAGFRTAVFSLLDNIIVSRPPRCNATGAAHKETIYANPKSYRSKRGLNKNRDKGSMKIRHGRVERGDMFRFDIWRDARGKYVCVPIFVADTKGKDDNNFKVPDGEFICSLHKDDYVRIYTSNQVIEGYISQMQEVIHGDKIYRYLALYTHDNHKTIVCKDDKSKAVPEIFRANVSDATNIEKFAMSLLGTPKPIKLPEQRTPVVK

SEQ ID NO: 5750 - protein, 955 aa, unidentified
  REGION 1..955: note = Description of Unknown:uncultivated organism
  REGION 1..955: note = MG40-33 effector
MSLIFGFDLGIPSIGWAAVKISDPTASATDAAAPDKRPAGEILGAGVRCFDQAQNAADRRMVRGARRRIRHRAQRMREIRAILRKYNLIDIPEPKSNGKNNFYLNRDTDINIWQLRAVDAFTRKLTPRETGRILYHLAKHRGYDDITYPVSADTKSEKADNADAKEELKAIGEIKRNLAKLHNENPNQTMCQMLYAINHSQHIKMRNGRKSGTKIAKDGTQKTELQSPYSNSIPRSQIKREAEMILRAQRDFGNDFSNVFTKWFDVAFRQRKFNESASPLAKSIEEMRGKCPFTNEPVAPKESPTAQMFVALTKCRQNDFTVEETKKIIDELYKKKTGLKYADVRELLKWDDDRRFKTLNYSRTYDKENKILIEPDIKKIEDRKFYAFTGWHKLAKYTTDIATMDKIFDIIATQKTPENIERAVSEILPEHAAAIAQITSSEFIKLSISALQKIIPEMEKGKKYNEAVAAGLNQDFRAQNVSYINRDDGASAGYLHQINWCLLGNRITSPVAKRTLGQLRKVYNAMVYRFGSPDRIHLEIGRELKNSPDDIARMKREQERNRQATADARKEYGKNYFKYKLYMEQGGKCPYCNATLVAGDWAAYEIDHILPYSRSLDNSQSNKVLVCHECNQRKGSKTPYEFLTSEQFFDMTVRARALHNPAKFKKQTNTDLPQSNDDQNGFIERNANDNATIAKFAAEYLEYGIDWSASDDIKKRVLVRTGSLTDYLRHQWGLVKNRDESDRHHAQDAIVIACATQGMVKYLSTLSARFENKYALIQKNGQAWYNALKTSIQEPWDGFRTDVISCLGNVIVSRPPRCNATGAAHDETIYADPKSYRSKRGMNKNRDKGSLEIRHGRAVRGNMFRFDIWRNARGKYVCVPIFVTDTKGKDDDAFKIPDGEFVCSLHKDDYVRLTTADGMYEGYITQMDHGRNFILYRQDNSKNIVVTKAVGKCTN

SEQ ID NO: 5751 - protein, 1065 aa, unidentified
  REGION 1..1065: note = Description of Unknown:uncultivated organism
  REGION 1..1065: note = MG47-1 effector
MKLKLGLDIGIASVGWGIIDENYDVKDSGVRLFSEGTAKANETRRVMRGQRRRLRRQKHRLYRMGKLLSDVLNIDYPEIVGNIYEIRCRGIKEPISTEELYLAIMYLTKFRGTHFLTAEDFQINDSGENLSKVLANLDDKEYVCNIQYKYFLEHGEIRGTECNHFRNKDYKRELDKLLQVQAKYHKELSENICKEIETIYSSKREYYEGPGSEKSPTPYGCWRYDEHGEKIQVNIIDEMRGYCTYFAKEKRIAKQSYTACLFNLLNDLNNLLIDGRKITYEEKKKLITEYIDNGKPLTEKIIKKVLAVKNDISGYRVDSKGKAIFTKFEGYNSIIKVYKDLNIDNTLIKGNRELMDKIAEILTKEKNIEKAKAELINIGLEAVADELVKLPKFTQYHSLSKKAMELILDDLWHESKNQMQLFNEAGMKPEKNSIAKGKNIKIDMSEWIVSPVTLRAVNETIKVINAARDFVRKKYNQELAEIIVEMPRDKNSDEQKKRILKAQKLNESQHKAIQAMVDGRNINGKIFLLLKLLQEQDFKCAYSGKSITVADVLNGIVSLEVDHIIPISVSFDDSLANKVAVLREENQNKGQRTPYQYFNSGRAKISWQEYRDNVLNNKTYSNKKKANLLYEGDLNKDLLGFVGRNLSDTRYASRKVLNTLQEYFKMNEIPTKVKVVNGAFTHQFRKQAKLSKNREETFAHHAQDALIIAGLSNVSIMKVLDDILTKDIKAMDDKTNILVKNGKVINQATGEILSEGDFSDKTGNYIRFIKHVENRKQKYSHKVDRKPNRQLYAQQVKGTRVRENNKGNMENWIVTKYKDIYSTAHNNSGTKLADLIRKKKEPEKLLMYQHDYKTYEVFKKIVENYPDEKNPFAAYKADYGYIRKYAKKGNGPIINDVKFLEKKLGNHRVNTKIAGSNKSVYLSIKTLRADVYLQAGKYSIIDVPYDMLDCTANGYVINKGKYALAKQKKKLNNTAEFCFSLYNGERFDYKDKAGICYTWIYSCIADGKNNKIEVKFIDKPSPASTQGKRLKTIGVNVCNMVKYNVDILGNEHPIKKEKFVDHFTK

SEQ ID NO: 5752 - protein, 1064 aa, unidentified
  REGION 1..1064: note = Description of Unknown:uncultivated organism
  REGION 1..1064: note = MG47-2 effector
MNFKLGLDLGVASVGWGIIDENYNIIDSGVRLFSEASAKENVKRREMRSSRRRVRRVRHRLDRMGILLSEILEIDLPEPFGNIYEIRCRGLKEKLKKEELFLALMHLTKRRGTFYLTADDIENKEDNGKSTEEILLEQEIKLKENYICEIQYKEFLEKGRVRGTENRFKNKEYLHELEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRKSELEKRGIGKNIASEIAKLSGFTQYHSLSKKAINTIIGDLWSTGKNQMQLFHDCGLTEYKNRANLGEKIKFDGSEWIVSPITKRTVTEAVKVINACRKMLKQKYNTEFSDVVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRAIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIAM

SEQ ID NO: 5753 - protein, 1034 aa, unidentified
  REGION 1..1034: note = Description of Unknown:uncultivated organism
  REGION 1..1034: note = MG47-3 effector
ASVGWGIIDENYEIIDSGVRLFSERSADDNVVRRTSRSTRRRIRRLQHRLERMRNFLLEIFRIKKLNSEEYNIYEVRCRGLEQKLSKDEIIRAILHLTKRRGTHFLTAEDFIELNNEKSTESILQEQEEKLANAYVCQIQLENFNRNKVRGIENRFRNKEYLKELTKLLETQGQYYKEILNNKDEIIKIYSSKREYFEGPGSEKSPTPYGRWRYDEQGKLIEVNLIELMRGVCTFFPEEKRIAKNSYTACLFNLLNDLNNLTVEGREISFDEKNILISQYVNKGKNVSLNNIASVCNCNKEDIRGYRVNKDDKAIFTEFSGYIEILKAVKKSGEDNCDIVGNRKLVDEIAEILTKEKNVEERFDKLILLKLKDTVAEELSKLNKFTQYHALSKKAMELILDDLLESNLNQMQLFFQNGLAEKKNQDLKGSTIKFDGSDWIVSPVTKRAISETVKVINAVRKKIRKEFNADFSEIVIEMAREKNTKDKLVFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKANNLNTKISVIKGSFTHYFRKKAKLNKNRELTYAHHAQDALIVAGLSNIDLMKKVQNIATVIEDKDNIIVKDNKIVNIATGEIISKEDFSAGKYIQFIKGVELVKPKYSFKVDKKPNRQLYDANIKATRTIDDKTSVITKYKNIYDVSGEKLKEKILQNPEDLLMYHYDEKTFKIFQEIVNHYVDSKNPFNQYFLETGMKVRKYAKDGNGPEINDVKFCDGELGNHRKNIKQVSENKSVYLQIKTLRADFYLDEGIYKFVTVPYDMIKPVGTEFEIEKDKYEDAKNLKKISKKAEYLFSLHRGERFSYINKGEYFEYNYTCVNNDKTNRLDVKYFDKPNDKQIMKTIGKNISELKKYNIDVLGNKYEVQREELRFNVSL

SEQ ID NO: 5754 - protein, 1057 aa, unidentified
  REGION 1..1057: note = Description of Unknown:uncultivated organism
  REGION 1..1057: note = MG47-4 effector
KINIKLNLEANKVKLKLGLDIGVASVGWGIIDENYEIIDSGVRLFSERSADDNVVRRTSRSTRRRIRRLQHRLERMRNFLLEMFGIEKLNSEEYNIYEVRCRGLEQKLSKDEIIRAILHLTKRRGTHFLTAEDFIELNNEKSTESILQEQEEKLANAYVCQIQLENFNKNKVRGIENRFRNKEYLKELTKLLETQGQYYKEILNNKDEIIKIYSSKREYFEGPGSEKSPTPYGRWRYDEQGNLIEVNLIELMRGACTFFPEEKRIAKNSYTACLFNLLNDLNNLTVEGREISFDEKNILISQYVNKGKNVSLNNIASVCNCNKEDIRGYRVNKDDKAIFTEFSGYIEILKAVKKSGEDNCDIVGNRKLVDDIAEILTKEKNVEERFDKLILLKLKDTVAEELSKLNKFTQYHSLSKKAMELILDDLLESNLNQMQLFFQNGLAEKKNQDLKGSTIKFDGSDWIVSPVTKRAVSETVKVINAVRKKVRKEFNADFSEIVIEMAREKNTKDKLVFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKANNLNTKISVIKGSFTHYFRKKAKLNKNRELTYAHHAQDALIVAGLSNIDLMKKVQNIAKAIGDKENIIVKDNKIVNIATGEIISKEDFSAGKYIQFIKGVELVKPKYSFKVDKKPNRQLYDANIKATRTIDDKTSVITKYKNIYDGSGEKLKEKILQKPEDLLMYHYDEKTFKIFQEIVKQYADSKNPFNQYFLETGMKVRKYAKDGNGPEINDVKFCDGELGNHRKNIKQVSENKSVYLQIKTLRADFYLDEGIYKFVTVPYDMIKPVGTEFEIEKDKYEAAKNLKKISKKAEYLFSLHRGERFSYIDKGEYFEYNYTCVNNDKTNRLDVKYFDKPNDKQIKKTIGKNISELKKYNIDVLGNKYEVQREELRFNVSL

SEQ ID NO: 5755 - protein, 969 aa, unidentified
  REGION 1..969: note = Description of Unknown:uncultivated organism
  REGION 1..969: note = MG47-5 effector
LNSEEYNIYEVRCRGLEQKLSKAEIIRPILHLTKRRGTHFLTAEDFIELNNEKSTESILQEQEEKLANAYVCQIQLENFNKNKVRGIENRFRNKEYLKELTKLLETQGQYYKEILNNKDEIIKIYSSKREYFEGPGSEKSPTPYGRWRYDEQGKLIEVNLIELMRGACTFFPEEKRIAKNSYTACLFNLLNDLNNLMVEGREISFDEKNILISQYVNKGKNVSLNNIASVCNCNKEDIRGYRVNKDDKAIFTEFSGYIEILKAVKKSGEDNCDIVGNRKLVDDIAEILTKEKNVEERFDKLILLKLKDTVAEELSKLNKFTQYHSLSKKAMELILDDLLESNLNQMQLFFQNGLAEKKNQGLKGSTIKFDGSDWIVSPVTKRAVSETVKVINAVRKKIRKEFNADFSEIVIEMAREKNTKDKLVFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKVNNLNTKISVIKGSFTHYFRKKAKLNKNRELTYAHHAQDALIVAGLSNIDLMKKVQNIAKAIDDKENIIVKDNKIVNIATGEIISKEDFSAGKYIQFIKGVELIKPKYSFKVDKKPNRQLYDANIKATRTIDDKTSVITKYKNIYDVSGEKLKEKILQKPEDLLMYHYDEKTFKIFQEIVNHYVDSKNPFNQYFLETGMKVRKYAKDGNGPEINDVKFCDGELGNHRKNIKQVSENKSVYLQIKTLRADFYLDEGIYKFVTVPYDMIKPVGTEFEIEKDKYEDAKNLKKISKKAEYLFSLHRGERFSYINKGEYFEYNYTCVNNDKKNVIDVKCFDKPNDKRIMKTIGKNISELKKYNIDVLGNKYEVQREELRFNVSL

SEQ ID NO: 5756 - protein, 1073 aa, unidentified
  REGION 1..1073: note = Description of Unknown:uncultivated organism
  REGION 1..1073: note = MG47-6 effector
MIGMKLILGLDIGIASVGYGIINENFEIITTGARLFSEGAAANNLERRTFRGTRRRIRRVKHRLTRMKELLFDVFGEHEAESFDNIYEIRCKGLRERLEPQEIMAAILHLTKRRGIHYLTAEDVDLDSASKGEVAQTLTENSEKLGSRYICELQLEELKKTGVVRGVENKFVHQKYEQELDALLEKQSEYYEELGKAIEAIKKIYNSKREFFEGPGSKISPTPYGRFRYNAEGNVEEVNLLDLMRGKCTYFPDEKRMAKWSYTTCLFNLLNDLNNLTVRGNTTGDDKLSYEQKKELIDNKINQGRNITLNDIAKVCGVEPDAISGYREDKSGKAIFTTFDGYKKVLTKAKTLGVQDLIIGNRELVDTIADILTQEKDIVKREEALVEAGIAKEFAVEISKIDAFKEYHSLSKKAIELILSDLWHTNKNQMQLFTEAGLSDEKLVAVKGKELAVDLDNWIVSPVTKRSVNETVKVINALRAWIKKQYGKDTEFSDIVIEMAREKNSEDKKQWIKKIQKEQETRKRDALLMAGDRKPNGTEMLMLSLLAEQDWKCAYSLQPISVDEVFKSKALEIDHIIPRSISFSDARSNKVVVKSVENQKKKNRTPYYYFSSGDNKNGISYEEFKQHVLANKKFSRAKKANLLYEENPLEHVQDFINRNLVDTRYASRKVLNLLQQFVKANELPTSVKVINGLVTHRFRAKAMLDKDRDATYAHHAQDALIIAGMGNTNILKTLTKWNAFSDGFADEKFIVDEFGQLIDKETGEIITNEDMDAPKYIRFIKSVEKVTPKFSFKVDRKPNRQLYDQQIKSTRVVTNDKGKDEAYIVTKYSDIYNSGANSSGEKLKKKILEHPETLLMYKHDPKTFEIFKKIVDEYKDEKNPFAAYKEDHGKIRKYSKKGIGPEIDSVKFLDGKLGSHRVNTKQTGNHQSVFLQLKSLRVDVYLDDGVYKLVNVLYDMVKNTATKYIVDEIKYEAAKTKKKISAKAEFLFSLYRGEMISYKKDGELETWIFSCMNNDKTNCVEFKFPDKPSPGNTQPKRMHTIGKKITDFTKYHVDVLGNAYPITREKLQMEIEK

SEQ ID NO: 5757 - protein, 1067 aa, unidentified
  REGION 1..1067: note = Description of Unknown:uncultivated organism
  REGION 1..1067: note = MG47-7 effector
MKLKLGLDIGIASVGWGIIDENYDVKDSGVRLFSEGTAKANETRRVMRGQRRRLRRQKHRLYRMGKLLSDVLNIDYPEIVGNIYEIRCRGIKEPISTEELYLAIMYLTKFRGTHFLTAEDFQINDSGENLSKVLANLDDKEYVCNIQYKYFLEHGEIRGTECNHFRNKDYKRELDKLLQVQAKYHKELSENICKEIETIYSSKREYYEGPGSEKSPTPYGRWRYDEHGEKIQVNIIDEMRGYCTYFAKEKRIAKQSYTACLFNLLNDLNNLLIDGRKITYEEKKKLITEYIDNGKPLTEKIIKKVLAVKNDISGYRVDSKGKAIFTKFEGYNSIIKVYKDLNIDNTLIKGNRELMDKIAEILTKEKNIEKAKAELINIDIGLEAVADELVKLPKFTQYHSLSKKAMELILDDLWHESKNQMQLFNEAGMKPEKNSIAKGKNIKIDMSEWIVSPVTLRAVNETIKVINAARDFVRKKYNQEFAEIIVEMPRDKNSDEQKKRILKAQKLNESQHKAIQAMVDGRNINGKIFLLLKLLQEQDFKCAYSGKSITVADVLNGIVSLEVDHIIPISVSFDDSLANKVAVLREENQNKGQRTPYQYFNSGRAKISWQEYRDNVLNNKTYSNKKKANLLYEGDLNKDLLGFVGRNLSDTRYASRKVLNTLQEYFKMNEIPTKVKVVNGAFTHQFRKKAKLSKNREETFAHHAQDALIIAGLSNVSIMKVLDDILTKDIKAMDDKTNLLVKNGKVINQATGEILSEGDFSDKTGNYIRFIKHVENRKQKYSHKVDRKPNRQLYAQQVKGTRVRENNKGNMETWIVTKYKDIYSTAHNNSGTKLADLIRKKKEPEKLLMYQHDYKTYEVFKKIVENYPDEKNPFAAYKADYGYIRKYAKKGNGPIINDVKFLEKKLGNHRVNTKIAGSNKSVYLSIKTLRADVYLQSGKYSIIDVPYDMLDCTANGYVINKGKYALAKQKKKLNNTAEFCFSLYNGERFDYKDKAGICYTWIYSCIADGKNNKIEVKFIDKPSPASTQGKRLKTIGVNVCNMVKYNVDILGNEHPIKKEKFVDHFTK

SEQ ID NO: 5758 - protein, 801 aa, unidentified
  REGION 1..801: note = Description of Unknown:uncultivated organism
  REGION 1..801: note = MG47-8 effector
MKLKLGLDIGVASVGWGIIDENYEIIDSGVRLFSERSADDNVVRRTSRSTRRRIRRLQHRLERMRKFLLEIFRIEKLNSKEYNIYEVRCRGLEQKLSKDEIIRAILHLTKRRGTHFLTAEDFIELNNEKSTESILQEQEEKLANAYVCQIQLENFNKNKVRGIENRFRNKEYLKELTKLLETQGQYYKEILNNKDEIIKIYSSKREYFEGPGSEKSPTPYGRWRYDEQGKLIEVNLIELMRGVCTFFPEEKRIAKNSYTACLFNLLNDLNNLMVEGREISFDEKNILISQYVNKGKNVSLNNIASVCNCNKEDIRGYRVNKDDKAIFTEFSGYIEILKAVKKSGEDNCDIVGNRNVVDDIAEILTKEKNVEERFDKLIFLKLKETVAEELSKLNTFTQYHSLSKKAMELILDDLLESNLNQMQLFFQNGLAEKKNQGLKGSTIKFDGSDWIVSPVTKRAVSETVKVINAVRKKIRKEFNADFSEIVIEMAREKNTKDKLAFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKANNLNTKISVIKGSFTHYFRKKAKLNKNRELTYAHHAQDALIVAGLSNIDLMKKVQNIATVIEDKENIIVKDNKIVNIATGEIISKEDFSAGKYIQFIKGVELIKPKYSFKVDKKPNRQLYDANIKATRTIDDKT

SEQ ID NO: 5759 - protein, 1057 aa, unidentified
  REGION 1..1057: note = Description of Unknown:uncultivated organism
  REGION 1..1057: note = MG47-9 effector
MKLKLGLDIGVASVGWGIIDENYEIIDSGVRLFSERSADDNVVRRTSRSTRRRIRRLQHRLERMRKFLLEIFRIEKLNSKEYNIYEVRCRGLEQKLSKDEIIRAILHLTKRRGTHFLTAEDFIELNNEKSTESILQEQEEKLANAYVCQIQLENFNKNKVRGIENRFRNKEYLKELTKLLETQGQYYKEILNNKDEIIKIYSSKREYFEGPGSEKSPTPYGRWRYDEQGKLIEVNLIELMRGVCTFFPEEKRIAKNSYTACLFNLLNDLNNLTVEGREISFDEKNILISQYVNKGKNVSLNNIASVCNCNKEDIRGYRVNKDDKAIFTEFSGYIEILKAVKKSGEDNCDIVGNRNLVDDIAEILTKEKNVEERFDKLILLKIKDTVAEELSKLNKFTQYHSLSKKAMELILDDLLESNLNQMQLFFQNGLAEKKNQGLKGSTIKFDGSDWIVSPVTKRAVSETVKVINAVRKKIRKEFNADFSEIVIEMAREKNTKDKLAFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKANNLNTKISVIKGSFTHYFRKKAKLNKNRELTYAHHAQDALIVAGLSNIDLMKKVQNIATVIEDKENIIVKDNKIVNIATGEIISKEDFSAGKYIQFIKGVELVKPKYSFKVDKKPNRQLYDANIKATRTIDDKTSVITKYKNIYDVSGEKLKKKILQNPEYLLMYHYDEKTFKIFQEIVDHYVDSKNPFNQYFLETGMKVRKYAKDGNGPVINDVKFCDGELGNHRKNIKQVSKNKSIYLKIKTLRADFYLDEGIYKFVTVPYDMIKPVGTEFEIEKDKYEDAKNLKKISKKAEYLFSLHRGERFSYINKGEYFEYNYTCVKDDKRNKIEAKYYDKPQIDSKDKEKPDSKNEPPTTSVGKNISEFKKYNIDVLGNKYEVQREELRFNVSL

SEQ ID NO: 5760 - protein, 1045 aa, unidentified
  REGION 1..1045: note = Description of Unknown:uncultivated organism
  REGION 1..1045: note = MG47-10 effector
MKLKLGLDIGVASVGWGIIDENYEIIDSGVRLFSERSADDNVVRRTSRSTRRRIRRLQHRLERMRKFLLEIFRIEKLNSKEYNIYEVRCRGLEQKLSKDEIIRAILHLTKRRGTHFLTAEDFIELNNEKSTESILQEQEEKLANAYVCQIQLENFNRNKVRGIENRFRNKEYLKELTKLLETQGQYYKEILNNKDEIIKIYSSKREYFEGPGSEKSPTPYGRWRYDEQGKLIEVNLIELMRGVCTFFPEEKRIAKNSYTACLFNLLNDLNNLTVEGREISFDEKNILISQYVNKGKNVSLNNIASVCNCNKEDIRGYRVNKDDKAIFTEFSGYIEILKAVKKSGEDNCDIVGNRKLVDEIAEILTKEKNVEERFDKLILLKLKDTVAEELSKLNKFTQYHSLSKKAMELILDDLLESNLNQMQLFFQNGLAEKKNQDLKGSTIKFDGSDWIVSPVTKRAVSETVKVINAVRKKIRKEFNADFSEIVIEMAREKNTKDKLVFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKANNLNTKISVIKGSFTHYFRKKAKLNKNRELTYAHHAQDALIVAGLSNIDLMKKVQNIATVIEDKENIIVKDNKIVNIATGEIISKEDFSAGKYIQFIKGVELVKPKYSFKVDKKPNRQLYDANIKATRTIDDKTSVITKYKNIYDVSGEKLKEKILQKPEDLLMYHYDEKTFKIFQEIVKQYADSKNPFNQYFLETGMKVRKYAKDGNGPEINDVKFCDGELGNHRKNIKQVSENKSVYLQIKTLRADFYLDEGIYKFVTVPYDMIKPVGTEFEIEKDKYEAAKNLKKISKKAEYLFSLHRGERFSYIDKGEYFEYNYTCVNNDKTNRLDVKYFDKPNDKQIKKTIGKNISELKKYNIDVLGNKYEVQREELRFNVSL

SEQ ID NO: 5761 - protein, 869 aa, unidentified
  REGION 1..869: note = Description of Unknown:uncultivated organism
  REGION 1..869: note = MG47-11 effector
MKLKLGLDIGVASVGWGIIDENYEIIDSGVRLFSERSADDNVVRRTSRSTRRRIRRLQHRLERMRKFLLEIFRSEKLNSEEYNIYEVRCRGLEQKLSKDEIIRAILHLTKRRGTHFLTAEDFIELNNEKSNESILQEQEEKLANAYVCQIQLENFNRNKVRGIENRFRNKEYLKELTKLLETQGQYYKEILNNKDEIIKIYSSKREYFEGPGSEKSPTPYGRWRYDEQGNLIEVNLIELMRGACTFFPEEKRIAKNSYTACLFNLLNDLNNLTVEGREISFDEKNILISQYVNKGKNVSLNNIASVCNCNKEDIRGYRVNKDDKAIFTEFSGYIEILKAVKKSGEDNCDIVGNRKLVDEIAEILTKEKNVEERFDKLILLKLKDTVAEELSKLNKFTQYHSLSKKAMELILDDLLESNLNQMQLFFQNGLAEKKNQDLKGSTIKFDGSDWIVSPVTKRAVSETVKVINAVRKKVRKEFNADFSEIVIEMAREKNTKDKLVFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKANNLNTKISVIKGSFTHYFRKKAKLNKNRELTYAHHAQDALIVAGLSNIDLMKKVQNIATVIEDKENIIVKDNKIVNIATGEIISKEDFSAGKYIQFIKGVELVKPKYSFKVDKKPNRQLYDANIKATRTIDDKTSVIRKYKNIYDVSGEKLKKKILQKPEYLLMYHYDEKTFKIFQEIVNHYVDSKNPFNQYFLETGMKERK

SEQ ID NO: 5762 - protein, 847 aa, unidentified
  REGION 1..847: note = Description of Unknown:uncultivated organism
  REGION 1..847: note = MG47-12 effector
MKLKLGLDIGVASVGWGIIDENYEIIDSGVRLFSERSADDNVVRRTSRSTRRRIRRLQHRLERMRNFLLEIFGIEKLNSEEYNIYEVRCRGLEQKLSKDEIIRAILHLTKRRGTHFLTAEDFIELNNEKSTESILQEQEEKLANAYVCQIQLENFNKNKVRGIENRFRNKEYLKELTKLLETQGQYYKEILNNKDEIIKIYSSKREYFEGPGSEKSPTPYGRWRYDEQGKLIEVNLIELMRGVCTFFPEEKRIAKNSYTACLFNLLNDLNNLTVEGREISFDEKNILISQYVNKGKNVSLNNIASVCNCNKEDIRGYRVNKDDKAIFTEFSGYIEILKAVKKSGEDNCDIVGNRNLVDEIAEILTKEKNVEERFDKLILLKIKDTVAEELSKLNKFTQYHSLSKKAMELILDDLLESNLNQMQLFFQNGLAEKKNQGLKGSTIKFDGSDWIVSPVTKRAVSETVKVINAVRKKIRKEFNADFSEIVIEMAREKNTKDKLAFIKKVQKEQEKINKEIKDHTGENKVSSKIAQTIKLWLEQDCKCAYSQQAISINDIMDGNVEIDHIIPLSLSFDDSQSNKVAVYIYENQKKGQRTPLQYLKSGSGKISYDQYKAWVIKTYAKNKKKRENLLYEGDPRIDLTGFINRNLNDTRYASKEVLNLLQSYFKVNNLNTKISVIKGSFTHYFRKKAKLNKNRELTYAHHAQDALIVAGLSNIDLMKKVQNIATVIEDKENIIVKDNKIVNIATGEIISKEDFSAGKYIQFIKGVELIKPKYSFKVDKKPNRQLYDANIKATRTIDDKTSVIRKYKNIYDVSGEKLKEKILQKPEDLLMYHYDEKTFKIFQEIVK

SEQ ID NO: 5763 - protein, 1064 aa, unidentified
  REGION 1..1064: note = Description of Unknown:uncultivated organism
  REGION 1..1064: note = MG47-13 effector
MNFKLGLDLGVASVGWGIIDENYNIIDSGVRLFSEASAKENVKRREMRSSRRRVRRVRHRLDRMGILLSEILEIDLPEPFGNIYEIRCRGLKEKLKKEELFLALMHLTKRRGTFYLTADDIENKEDNGKSAEEILLEQEIKLKGNYICEIQYKEFLENGKVRGTENRFKNKEYLREVEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRQSELEKRGVEKNIAAEIAKLSGFTQYHSLSKKAINMIINDLWASDKNQMQLFHDCGLTEYKNSANLGEKIKFDGSEWIVSPITKRTVNEAVKVINACRKMLKQKYNTEFSDIVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTKYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRTIIDEKGKEKTYVITKYKNIYVEGIGSTGDKLAERIRKNPESLLMYHNDPATFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDMEKYQAAKVQKGINGDAEFKFSLHRGEFFSYKKDKEEFWWQFSCVNSDIKNVIETKYIDKPSPGNTQKYRMITIGKKITDMCKYNVDVLGNIYPVDKEILKVEIEM

SEQ ID NO: 5764 - protein, 1064 aa, unidentified
  REGION 1..1064: note = Description of Unknown:uncultivated organism
  REGION 1..1064: note = MG47-14 effector
MNFKLGLDLGVASVGWGIIDENYNIIDSGVRLFSEASAKENVKRREMRSSRRRVRRVRHRLDRMGILLSEILEIDLPEPFGNIYEIRCRGLKEKLKKEELFLALMHLTKRRGTFYLTADDIENKEDNGKSAEEILLEQEIKLKGNYICEIQYKEFLENGKVRGTENRFKNKEYLREVEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRQSELEKRGVEKNIAAEIAKLSGFTQYHSLSKKAINMIINDLWASDKNQMQLFHDCGLTEYKNSANLGEKIKFDGSEWIVSPITKRTVNEAVKVINACRKMLKQKYNTEFSDIVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRAIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDLEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 5765 - protein, 1064 aa, unidentified
  REGION 1..1064: note = Description of Unknown:uncultivated organism
  REGION 1..1064: note = MG47-15 effector
MNFKLGLDLGVASVGWGIIDENYNIIDSGVRLFSEASAKENVKRREMRSSRRRVRRVRHRLDRMGILLSEILEIDLPEPFGNIYEIRCRGLKEKLKKEELFLALMHLTKRRGTFYLTADDIENKEDNGKSTEEILLEQEIKLKENYICEIQYKEFLEKGRVRGTENRFKNKEYLHELEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTELKQYKDILKVFDKFGDRKLVEGNALLCDDIAEVLTKEKSVDIRKSELEKRGIEKNIASEIAKLSGFTQYHSLSKKAINTIIGDLWSTGKNQMQLFHDCGLTEYKNRANLGEKIKFDGSEWIVSPITKRTVTEAVKVINACRKMLKQKYNTEFSDVVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRAIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 5766 - protein, 1064 aa, unidentified
  REGION 1..1064: note = Description of Unknown:uncultivated organism
  REGION 1..1064: note = MG47-16 effector
MNFKLGLDLGVASVGWGIIDENYNIIDSGVRLFSEASAKENVKRREMRSSRRRVRRVRHRLDRMGLLLSEILEIDLPEPFGNIYEIRCRGLKEKLKKEELFLALMHLTKRRGTFYLTADDIENKEDNGKSAEEILLEQEIKLKGNYICEIQYKEFLENGKVRGTENRFKNKEYLREVEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRQSELEKRGVEKNIAAEIAKLSGFTQYHSLSKKAINMIINDLWASDKNQMQLFHDCGLTEYKNSANLGEKIKFDGSEWIVSPITKRTVNEAVKVINACRKMLKQKYNTEFSDIVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRTIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDLEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 5767 - protein, 1064 aa, unidentified
  REGION 1..1064: note = Description of Unknown:uncultivated organism
  REGION 1..1064: note = MG47-17 effector
MNFKLGLDLGVASVGWGIIDENYNIIDSGVRLFSEASAKENVKRREMRSSRRRVRRVRHRLDRMGLLLSEILEIDLPEPFGNIYEIRCRGLKEKLKKEELFLALMHLTKRRGTFYLTADDIENKEDNGKSAEEILLEQEIKLKGNYICEIQYKEFLENGKVRGTENRFKNKEYLREVEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRQSELEKRGVEKNIAAEIAKLSGFTQYHSLSKKAINMIINDLWASDKNQMQLFHDCGLTEYKNSANLGEKIKFDGSEWIVSPITKRTVNEAVKVINACRKMLKQKYNTEFSDIVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRTIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 5768 - protein, 1067 aa, unidentified
  REGION 1..1067: note = Description of Unknown:uncultivated organism
  REGION 1..1067: note = MG47-18 effector
MYKLGIDIGVSSVGWGIIDDKYNIVDCGVRLFSERSKDSNVDRRGFRSSRRRIRRVKHRLERMKNLLENVLNIKIKQNTFSSNPYAVREKGISEKLSKEELVQAILHLTKRRGTHFLTAEDFENQNGEKTVEKILSEQEANSQDKYVCQMQNEKHMSICTLKQYMGKVRGAENRFRNKKYLEELQQLLKIQANFYPEIEQSKEAIENIYSSKREYWEGPGSEKSPSKYGQYRYGNDGRVIKVNLIDIMRGKCTYYPQEARIAKQSYSACLFNLLNDLNNILINNEKITFEQKQELVEKYIDEGKNINLQAIASVSGVKKELVSGYRIDKDNKAIFTEFKGYKNILKALKVNNLDNQFIKGNRRLVDEIVEIMTKEKDVEKIAADLQQLNGMSADSAGVISQISGISEYHALSLKAINTIIEDLWHTPKNQMVLFAESGLSGKKDRQLKSATIEIDIENWIVSPVVKRSVNETVKIINALRAKMQKEYGAEFEEIVIEMAREKNSEEKKNFINKIQKENEKNRQKIAELMEGKKISGEDFNKIRMLIEQGYKCAYSLRSMSPNDVLLGKAEVDHIIPLSLSFDDSQANKVLVYVSENQEKRQRTPRQYLKSGAGKVSFEEFKDWVCKTFEKNKQKRENLLYEGDPKKDIQGFINRNLVDTRYACKEVLNLLQRYFKQNEISTKVSVIKGGFTAYFRKKAKLSKERDKTFAHHAQDALIVAGLSNSSLLKKLNSIIRDYDLLIQSSDVMDDGKMINKDTGEVLGVIQESDFNSMDYIMFIKRVERVQPKFSHKVDRKPNRELYDQNIKATREQDGDKYIVTKCKNIYTSKDGEKLKELIETTPEKLLMYKHDYQSFEKMQQVVEFYKEAKNPFAEYYKEHNAKIRKYAKEGKYSPEIDNVKYLDKKLGNHRAINNPNSKNLAVLLSIKTLRADIYWDNNKYTFVSVPYDFIITKNNHKGGEVSYDIDLDKYNMAKVNKGISAKAKFLFSLHKGEFVSYIDKNNNYLEWYYSSVNNDSRNKIEVKEIGKPTAKQEMKTIGKDITELTKYHVDILGNRYPIKEEKLKLNNI

SEQ ID NO: 5769 - protein, 1064 aa, unidentified
  REGION 1..1064: note = Description of Unknown:uncultivated organism
  REGION 1..1064: note = MG48-1 effector
MNTTIIFPEDENEQTVLGLDMGSNSIGWFLQTVSANGMPKKIIAAGSRIFDNSRDPKTRVPLSVQKRLANASSTRRDRQIMRTKHLCKLLKEFKLLPPAEVKADVSNRNPYKLRAKAAEEKIDLYGIGRAILHINKRRGFLSNRKADKRANDEEAHGMKLGISNLRTHLADKTLGQYLYERQKSGKGTRMRAKAIKNKNHYEMYADRDMYVDEFQKIWRTQQKYHKNLDDEMGKKIEDALFFQRPLKTPERGFCQFEKGEKRAYKAYPISQKFRILQEVNALEVVNNGVIEVVLTPEDKKKLSEILLKNTSPHIKKGMLSFAEMKKILNIKRVHFFNFEAENRKGFYADSTYAVFASPDCFGDRWEKLDDDLRENIVDLIIQNKEKEFKRIANEQFGFDDEKCEKILDAAMSLEDGTTSLSAKAMHKISKFLEDGELYHSACNMAGYDFNAGYDGELYEKLPYYGEILRTATIGGNTNFDPHENPEKYYGKITNPTVHVALNQLRKLVNKIFEVYGAPDKIVIETARDLPLGEKGLGEINKRNLENKKENEKIGEVLQKLKVANNAKNRMKYRLWCDLNKDETKRCCPFCGKTIPPHKIFSPEFEIEHLLPFSITFDDSRGNKVLSCASCNRIFKGKHSPYEAFANNPSYNWNEIVARVSEMSWARQWRFKPDALKIFEDQFGDFIARMLNDTRYMSKVAREYLTAVLPKEKIITVPGTITGKLRARWGLNRILDTAAENDDESVKNRDDLRHHAVDAFVISSINRKLIALISRTARLAEEAGLENVLKALPSPFEKISYEQLKETIDNIKVSHKLDRGDVKAAIARGATVGKLHKDTAYGKIGKEEDGKLTLVKRVPLMNIEAKRDAIGQIANPQIRDALLEEFDKLAGLSESQIKNRWNEILMQFAEIKHVRRVRIHLKNRESHKLIKIADKSGNIYKYMDNDESYCIDIYKPSKSDKWNFEVINMYDAHKNEIPQWRKNDARAKLVMRLYKRDTIAYEENGEYKIARVTGIATHGQISLLGLQISRVEGNPPKKMPNVLQKLNARKIYIDEIGRVYDPKKK

SEQ ID NO: 5770 - protein, 1043 aa, unidentified
  REGION 1..1043: note = Description of Unknown:uncultivated organism
  REGION 1..1043: note = MG48-2 effector
MGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKIPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVMEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKDALKRGGTVAKLHKETAYGMIGSPYGGKATLAKRVPILSVECDEGQISEIANAKIRADLSRFCEQVSREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5771 - protein, 1072 aa, unidentified
  REGION 1..1072: note = Description of Unknown:uncultivated organism
  REGION 1..1072: note = MG48-3 effector
MKYRLGLDIGSSSIGWCIFETVNNIPVRIVDMGVRIFTDGRDPQKKTPLAVERRMARGARRQRDRRLQRINALVKQLKSCGLMPESKDAKKLELKNPYKIRAKAVHEEVSLYELGRALFHINRRRGFKSNRKADKGADENESSAMKKAIKDLNEKLGGQTLGEFLYERQNKGENVRVRAETIKNKNIYDMYADRSMYEKEFDRIWNTQSKFHKELTPELRQKIHYIIFNQRPLKVPERGFCQFEKDERREYLAMPISQIYRIYAEVAQLEIIAFEGDDKRLTPSERNAIANELLFNTKKLAKKDGEITFEKISQKILNLPKSTKFNLQSENRKGLFCDKTAFIISQEECFGADWHKFSFEKQSEIINTILNVSAKPLSDEELEELLSIKYSISKEKAVSILNKAMKLPDGTGSLSALAMSKILPHLKEWNIYNRACALAGYNFNQNYSGEILDKLPYYGQVLKTAALGANPTEENLKFPEKYYGKITNPTVHIALNQVRKVVNKLIDIYGKPDEIVVETARDLPLGEKGISELKKNQEKNKKDNDRIAKELEKVGVKNNYPNRMKFKIWEDLNKDEKQRCCPFCGKQIPLNAVDGLFSRHFEIEHLLPFSETFDDSRNNKVIACKDCNHMYKGKKSPFEAFGHIKDKDNPRNYDAILARAKDFANAEKRLWRFQEDAMRRFKDEESDLIARTMNDTRYMTRATREYLTSIVEAKNVYTVKGVITGLLRNKWGINKLLNDPALPPEEADEKNRNDNRHHAIDAFILCTISRAMIQRIAQSAKLCEEAGYEKIVSDIGKPFDDFDYEEMKKHLDKMLISFKPDRGNALNAVKNNKTLGSLHNETALGAINFKDGDNSLTLAKRIKIETLDFKEKNIEEVADEKIKKDLKAIYEEVVLAGADKKVWVEELSKYAKNNSIRRIRIHLRNRPSEKYIPIKDKNGKIYKYYANAENYCMDIYLPSGEKKWAFQPVSMFEAHQKNYVPKWRKTDPHAKLVMRLFKQDILAFEEDGKTVLRKITGLATHGQISFLPLNVNHIEGNPPKISPSSLQKLNARKVYIDEAGRLFDPGKAKYSE

SEQ ID NO: 5772 - protein, 824 aa, unidentified
  REGION 1..824: note = Description of Unknown:uncultivated organism
  REGION 1..824: note = MG48-4 effector
AERQGDEDESGLKKGIHALEGRLKEAQQTLGQYLHARLEKNAGLEKKLAIRLRKEDADERWTSRQMYRDEFERLMTAQQVYHPQLLTDDVVTALRETIFHQRPLKEAKAGFCALLDGKMRARLAYPQIQRFRIYQEVNNLNTIKEIPDTPEITAEMRQKIIRYLCTDFSELRKDGILSWRKIQKITGIKGVKFNLDELGRPGLQADTTSRSMMAAAPAWWLSLEDEQQRAVVDAVMTAQTDDDLKKQLDALFETLPADIPAALAKIRLPEGYGRISVEAAELLLPPLSLGMIYSDACQWVGINHSDDYDGVVYTKGNLPFYGEVLQKHVIGGTHDVQQRENPEMYYGKINNPTVHMALNQFRRVLNELVQQYGCPPQEIHLELARETALSAKDLEILKKEQTHNKKNNDKINEILRKLGVAESYDNRMKYRLWEDLDNDPSGRCCPLSGKAISLDLLYSPQIEEEHIIPFSRSFDDSRNNKMVCFKSANFLKGNSTPYEAFGQSAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAVDAIVIALTDPRMIQELAQANKRAYKQASDKMYLNLPLPFPDFSVAKIKAHLQTLVISHKQDHKHPEQARAQGGSIGQLHKDTNYGHIHGNVYATRIDLIVDEFSKRKNIDEIASRKIREAVMALFEPYADDEGKLKSSNKADYHHDLEAFKKQHDVKRVRIHQTRHNLIPICDSDGHAYRYVDGGNNFCAEIWMPNKGKQA

SEQ ID NO: 5773 - protein, 774 aa, unidentified
  REGION 1..774: note = Description of Unknown:uncultivated organism
  REGION 1..774: note = MG48-5 effector
DITDEHRRKLVEELTRNFQHVNKQGMLTWAKIRKILGLSRAAKFNLDELGRKGLSCDTTSHRLSNPDYLGDRWWTLTDDEKNELVDKLATEPNKDVLEQWLAVRFKLDAETAKKLANTRLAQGYGSVSLKAIRRLLPHLRAGMTYDKACAAEGIDHSDLHTGEIFVNGDLPYYGQLLRRYVIGGDQSFDPHEEPEKYYGKITNPTVHIALNQLRVVINALVRKYGPPSEIHIELARELPLGARGLSQLKSDIARGRKENERIDEELRKIGVVPNYSNRMKFKLWEDLAEQPHERCCPFTGKVISLSALFTDEFEVEHLLPFSLSFDDSRANKVISHRDANRFKGNRSPYEAFGDSPPGYDWDAIIARVENFANPHKKWRFQPDAWEIWKKNNGDVIARMLNDTRYMTRVAREYLSYACPKHKVVSVTGQLTALLRHHWGLNRLLSIEDVKERGDHRHHAIDALVVACTSRSALQKVSAAARNAQSTERLLERLEKPYPKFSFEKLKERIDALVVSYKPDHGKPKPGMTVGQLHEETYYGRLGDSDKKGYGIYVTRRPFTQIEPEAKKIDEIANIQIREDLLAAYERLKGDKKEWQRFLQDYAQANNVRRVRVHIQKSDDVMIPIKDKSGKPYRYVQGGNNYCADIWCTDKGPKAGKWQCEVISMFDAHQPDFRPRWRTEHPTAWRVMRLQINDTVAVEENGQRILVRVKKINSDGRVYLRQLNIAREQGDSLSKGAPASTLQRLNARKIFVSPIGEVKDPGHARKSDKCYGKAS

SEQ ID NO: 5774 - protein, 948 aa, unidentified
  REGION 1..948: note = Description of Unknown:uncultivated organism
  REGION 1..948: note = MG48-6 effector
KSNRKADKKSDGAESRGMKLGISKLREAMGDRTLGEFLYERKKSGMGTRMRADAIRGKNEYEIYADRDMYESELRRIWDCQRKYHRNLTDEMLNEISGALFFQRPLKIPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGVKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVMEPEKILTVTGSATSMLRAKWGLDAILDDSSPLQFGGESESSAAKAPKAPVKNREDHRHHAIDAFVISSLNRKLISAISQCAKRAEQAHLENLFKAIPRAYERISYEKLEAAVKSINVSHKLDRGDTKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5775 - protein, 750 aa, unidentified
  REGION 1..750: note = Description of Unknown:uncultivated organism
  REGION 1..750: note = MG48-7 effector
MDALASSFKIILEKNELKLNLDSIQAFDCLNPHIYYDLLEYAKSIVTDTVVLNDFKKQLDALFETLPADIPAALAKIRLPEGYGRISVEAAELLLPPLSQGMIYSDACQSVGINHSDDYDGVVYTKGNLPFYGEVLQKHVIGGTHDVQQRENAEMYYGKINNPTVHMALNQFRRVLNELVQQYGCPPQEIHLELARETALSAKDLDILKKEQTHNKKNNDKINEILRKLGVAESYDNRMKYRLWEDLDNDPSGRCCPLSGKAISLDLLYSPQIEVEHIIPFSRSFDDSRNNKMVCFKSANFLKGDYTPYEAFGQSVQWPDILARAKKMSPDAHKGGKNASGFRVNKFWRFLPDAMEQLQGDAESFLARQLNDTKYMARVARRYAEYVAGKHYVLAIKGKFTSDLRHHWGLDELVGNFSDGQFKKDRNNHHHHAIDAIVIALTDPRIIQELAQANKRAYKQASDKMYLNLPLPFPDFSVAKIKERLQTLVISHKQDHKRPEQARARGGSIGQLHDETNYGHIHDNVYATRIDLIVDKFSKRKNIDEIASRKIREAVMALFEPYADDKGELKSSNQADYHHDLEAFKEQYGVRRVRIHQTRHNLIPIRDSDGHAYRYVVGGNNFCAEIWMPTKGKQAGKWQCEIIRNFDINQKNFLPKWRQENPTAMKVMRLQINDMVALERDGERVIFRVQKMGMNGQIFLRQHNDSRTEKSTEISFMASTLQSRNARKLFVSPTGKIYDPGRAKQPKRKG

SEQ ID NO: 5776 - protein, 1077 aa, unidentified
  REGION 1..1077: note = Description of Unknown:uncultivated organism
  REGION 1..1077: note = MG48-8 effector
MENEKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKIPERGFCRFEPGERRAYKAYPVSQKIRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5777 - protein, 1077 aa, unidentified
  REGION 1..1077: note = Description of Unknown:uncultivated organism
  REGION 1..1077: note = MG48-9 effector
MENEKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKSPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRAYPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5778 - protein, 1077 aa, unidentified
  REGION 1..1077: note = Description of Unknown:uncultivated organism
  REGION 1..1077: note = MG48-10 effector
MENKKVFGFDMGANSIGWCVQIIGEDGFTLEILGMGSRIFENSRDPKTRVPLSVERRMAHAMSVRRGRQIMRTRNLCSILRKYGLLPSCENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKIPERGFCRFEPGERRAYKAYPVSQKFRILQEVNALEILDIAGGGEGITLSMRQKLARALLENDRKIVNKKGIATFAKIKKFLEIPRSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGEINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5779 - protein, 1077 aa, unidentified
  REGION 1..1077: note = Description of Unknown:uncultivated organism
  REGION 1..1077: note = MG48-11 effector
MENKKVFGFDMGANSIGWCVQIIGEDGFTLEILGMGSRIFENSRDPKTRVPLSVERRMAHAMSVRRGRQIMRTRNLCSILRKYGLLPSCENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKIPERGFCRFEPGERRAYKAYPVSQKFRILQEVNALEILDIAGGGEGITLSMRQKLARALLENDRKIVNKKGIATFAKIKKFLEIPRSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGEINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWSGILSRVSDMPKSKQWRFRPDAWEIFEEKYGDYIARMLNDTRYMSKLAREYLTSVIEPEKILTVTGSATSMLRAKWGLDAILDDSSPLQFGGESESSAAKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVSREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5780 - protein, 1077 aa, unidentified
  REGION 1..1077: note = Description of Unknown:uncultivated organism
  REGION 1..1077: note = MG48-12 effector
MENKKVFGFDMGANSIGWCVQIIGEDGFTLEILGMGSRIFENSRDPKTRVPLSVERRMAHAMSVRRGRQIMRTRNLCSILRKYGLLPSCENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKIPERGFCRFEPGERRAYKAYPVSQKFRILQEVNALEILDIAGGGEGITLSMRQKLARALLENDRKIVNKKGIATFAKIKKFLEIPRSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5781 - protein, 1077 aa, unidentified
  REGION 1..1077: note = Description of Unknown:uncultivated organism
  REGION 1..1077: note = MG48-13 effector
MENKKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSDMGTRMRADAIRGKNEYEIYADRGMYESELRRIWDCQRKYHRNLTDEMLNEISGALFFQRPLKSPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAAKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCTSNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5782 - protein, 1077 aa, unidentified
  REGION 1..1077: note = Description of Unknown:uncultivated organism
  REGION 1..1077: note = MG48-14 effector
MENKKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKIPERGFCRFEPGERRAYKAYPVSQKIRILQEVNALEILDIAGNGEGITLSMRQKLARALLENDRKIVNKKGIATFAKIKKFLGIPQSLNFNFESESRKGFDGDSTAAVMGSAECFGDAWADMDDCLCEKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAAKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5783 - protein, 1077 aa, unidentified
  REGION 1..1077: note = Description of Unknown:uncultivated organism
  REGION 1..1077: note = MG48-15 effector
MENKKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKSPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5784 - protein, 1077 aa, unidentified
  REGION 1..1077: note = Description of Unknown:uncultivated organism
  REGION 1..1077: note = MG48-16 effector
MENKKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKSPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYRGAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5785 - protein, 1077 aa, unidentified
  REGION 1..1077: note = Description of Unknown:uncultivated organism
  REGION 1..1077: note = MG48-17 effector
MENKKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLWAKAVSEKVDMFGIGRAILHMNKRRGFKSNRKADKKSDGAESRGMKLGISKLREAMGDRTLGEFLYERKKSGMGTRMRADAIRGKNEYEIYADRDMYESELRRIWDCQRKYHRNLTDEMLNEISGALFFQRPLKIPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGVKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVMEPEKILTVTGSATSMLRAKWGLDAILDDSSPLQFGGESESSAAKAPKAPVKNREDHRHHAIDAFVISSLNRKLISAISQCAKRAEQAHLENLFKAIPRAYERISYEKLEAAVKSINVSHKLDRGDTKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5786 - protein, 1077 aa, unidentified
  REGION 1..1077: note = Description of Unknown:uncultivated organism
  REGION 1..1077: note = MG48-18 effector
MKNKKVFGFDMGANSIGWCVQIIGEDGFTLEILGMGSRIFENSRDPKTRVPLSVERRMAHAMSVRRGRQIMRTRNLCSILRKYGLLPSCENVSVSERNPYKLRAKAVSEKVDMFGIGRAILHMNKRRGFKSNRKADKKSDGAESRGMKLGISRLREAMGDRTLGEFLYERKKSGMGTRMRADAIRGKNEYEIYADRGMYESELRRIWDCQRKYRRNLTDEMLNEISGALFFQRPLKIPERGFCRFEPGERRAYKAYPVSQNFRILQEVNALEILDIAGGGEGITLSMRQKLARALLENDRKIVNKKGIATFAKIKKFLEIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAAKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5787 - protein, 1074 aa, unidentified
  REGION 1..1074: note = Description of Unknown:uncultivated organism
  REGION 1..1074: note = MG48-19 effector
MKYRLGLDIGSSSIGWCIFETVNNIPVRIVDMGVRIFTDGRDPQKKTPLAVERRMARGARRQRDRRLQRINALVKQLKSCGLMPESKDAKKLELKNPYKIRAKAVHEEVSLYELGRALFHINRRRGFKSNRKADKGADENESSAMKKAIKDLNEKLGGQTLGEFLYERQNKGENVRVRAETIKNKNIYDMYADRSMYEKEFDRIWNTQSKFHKELTPELRQKIHYIIFNQRPLKVPERGFCQFEKDERREYLAMPISQIYRIYAEVAQLEIIAFEGDDKRLTPSERNAIANELLLNTKKLAKKDGEITFEKISQKILNLPKSTKFNLQSENRKGLFCDKTAFIMSQEECFGADWHKFSFEKQSEIINTILNVSAKPLSDEELEELLSIKYSISKEKAVSILNKAMKLPDGTGSLSALAMSKILPHLKEWNIYNRACALAGYNFNQNYSGEILDKLPYYGQVLKTAALGANPTEENLKFPEKYYGKITNPTVHIALNQVRKVVNKLIDIYGKPDEIVVETARDLPLGEKGISELKKNQEKNKKDNDRIAKELEKVGAKNNYQNRMKFKIWEDLNKDEKQRCCPFCGKQIPLNAIDGLFSRHFEIEHLLPFSETFDDSRNNKVIACKDCNHMYKGKKSPFEAFGHIKDKDNPRNYDAILARAKDFVNAEKRLWRFQEDAMRRFKDEESDLIARTMNDTRYMTRATREYLTSIVEAKNVYTVKGVITGLLRNKWGINKLLNDPALPPEEADEKNRNDNRHHAIDAFILCTISRAMIQRIAQSAKLCEEAGYEKIVSDIGKPFDDFDYEEMKKHLDKMLISFKPDRGNAVNAVKNNKTLGSLHNETALGAINFKDGSKTLTLAKRIKIETLDFKEKNIEEVADEKIKKDLKAIYEEVILAGADKKVWVEKLSKYAKNNSIRRIRIHLRNNELSTLIPIKDKNGKIYKYYANAENYCMDIYLPSGEKKWHFKPVSMFEAHQKNYIPKWRKTDPHAKLVMRLFKQDILAFEENGNIVYKRITSIWGSGVIQLMPLNKNFIDKDDKRTSKTPSSLQKLNARKVYIDEAGRLFDPGKAKYSE

SEQ ID NO: 5788 - protein, 1074 aa, unidentified
  REGION 1..1074: note = Description of Unknown:uncultivated organism
  REGION 1..1074: note = MG48-20 effector
MKYRLGLDIGSSSIGWCIFETVNNIPVRIVDMGVRIFTDGRDPQKKTPLAVERRMARGARRQRDRRLQRINALVKQLKSCGLMPESKDAKKLELKNPYKIRAKAVHEEVSLYELGRALFHINRRRGFKSNRKADKGADENESSAMKKAIKDLNEKLGGQTLGEFLYERQNKGENVRVRAETIKNKNIYDMYADRSMYEKGFDRIWNTQSKFHKELTPELRQKIHYIIFNQRPLKVPERGFCQFEKDERREYLAMPISQIYRIYAEVAQLEIIAFEGDDKRLTPSERNAIANELLLNTKKLAKKDGEITFEKISQKILNLPKSTKFNLQSENRKGLFCDKTAFIMSQEECFGADWHKFSFEKQSEIINTILNVSAKPLSDEELEELLSIKYSISKEKAVSILNKAMKLPDGTGSLSALAMSKILPHLKEWNIYNRACALAGYNFNQNYSGEILDKLPYYGQVLKTAALGANPTEENLKFPEKYYGKITNPTVHIALNQVRKVVNKLIDIYGKPDEIVVETARDLPLGEKGISELKKNQEKNKKDNDRIAKELEKVGVKNNYQNRMKFKIWEDLNKDEKQRCCPFCGKQIPLNAIDGLFSRHFEIEHLLPFSETFDDSRNNKVIACKDCNHMYKGKKSPFEAFGHIKDKDNPRNYDAILARAKDFVNAEKRLWRFQEDAMRRFKDEESDLIARTMNDTRYMTRATREYLTSIVEAKNVYTVKGVITGLLRNKWGINKLLNDPALPPEEADEKNRNDNRHHAIDAFILCTISRAMIQRIAQSAKLCEDAGYEKIVSDIGKPFDDFDYEEMKKHLDKMLISFKPDRGNAVNAVKNNKTLGSLHNETALGAINFKDGDNSLTLAKRIKIETLDFKEKNIEEVADEKIKKDLKAIYEEVVLAGADKKVWVEELSKYAKNNSIRRIRIHLRNRPSEKYIPIKDKNGKIYKYYANAENYCMDIYLPSGEKKWHFQPVSMFEAHQKNYVPKWRKTDPHAKLVMRLFKQDILAFEENGNIVYKRITSIWGSGVIQLMPLNKNFIDKDDKRTSKTPSSLQKLNARKVYIDEAGRLFDPGKAKYSE

SEQ ID NO: 5789 - protein, 1066 aa, unidentified
  REGION 1..1066: note = Description of Unknown:uncultivated organism
  REGION 1..1066: note = MG48-21 effector
MNTTIIFPEDENEQTVLGLDMGSNSIGWFLQTVSANGMPKKIIAAGSRIFDNSRDPKTRVPLSVQKRLANASSTRRDRQIMRTKHLCKLLKEFKLLPSAEGKADVSNRNPYKLRAKAAEEKIDLYGIGRAILHINKRRGFLSNRKADKRANDEEAHGMKLGISNLRMHLADKTLGQYLYERQKSGKGTRMRAKAIKNKNHYEMYADRDMYVDEFQKIWRTQQKYHKNLDDEMGKKIEDALFFQRPLKTPERGFCQFEKGEKRAYKAYPISQKFRILQEVNALEVVNNGVIEVVLTPEDKKKLSEILLKNTSPHIKKGMLSFAEMKKILNIKRVHFFNFEAENRKGFYADSTYAVFASPDCFGDRWEKLDDDLRENIIDLIIQNKEKEFKKIASEQFGFDDERCEKILDAAMSLEDGTTSLSAKAMRKISKFLEDGALYHSACNMAGYDFNAGYEGKLYKELPYYGEILRTATIGGNTKFNPENKNEKEKYYGKITNPTVHVALNQLRKLVNKIFHVYGAPDKIVIETARDLPLGEKGLSEINKNNAKNKKENERIAEELEKLNVANNAKNRMKYRLWEDLNPDPQKRCCPFCGKQIPPHKIFSPEFEIEHLLPFSITFDDSRGNKVLSCASCNRIFKGKHSPYEAFGNNPSYNWNEIVARVSEMSWARQWRFKPDALKIFEDQFGDFIARMLNDTRYMSKVAREYLTAVLPKEKIITVPGTITGKLRARWGLNRILDTAAESDDESVKNRDDLRHHAVDAFVISSINRKLIALISRTARLAEEAGLENVLKALPSPFEKISYEQLKETIDNIKVSHKLDRGDVKAAIARGATVGKLHKDTAYGKIGKEEDGKLTLVKRVPLMNIEAKRDAIGQIANPQIRDALLEEFDKLAGLSESQIKNRWNEILMQFAEIKHVRRVRIHLKNRESHKLIKIADKSGNIYKYMDNDESYCIDIYKPSKSDKWSFEVINMYDAHKNEIPQWRKNDARAKLVMRLYKRDTIAYEENGEYKIARVTGIATHGQISLLGLQISRVEGNPPKKMPNVLQKLNARKIYIDEIGRVYDPKKK

SEQ ID NO: 5790 - protein, 1073 aa, unidentified
  REGION 1..1073: note = Description of Unknown:uncultivated organism
  REGION 1..1073: note = MG48-22 effector
MNYRLGFDLGYTSLGWACVLLDGQNHPCEVYDFGVRIFPSGRDNQSRQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKEIPDTPEITAEMRQKIIRYLCTDFSELRKDGILSWRKIQKITGIKGVKFNLDELGRPGLQADTTSRSMMAAAPAWWLSLEDEQQRAVVDAVMTAQTDDDLKKQLDALFETLPADIPAALAKIRLPEGYGRISIEAAELLLPPLSQGMIYSDACQSAGINHSDDYDGVVYTKGNLPFYGEVLQKHVIGGTHDVQQRENPEMYYGKINNPTVHMALNQFRRVLNELVQQYGCPPQEIHLELARETALSAKDLEILKKEQTHNKKNNDKINEILRKLGVAESYDNRMKYRLWEDLDNDPSGRCCPLSGKAISLDLLYSPQIEEEHIIPFSRSFDDSRNNKMVCFKSANFLKGNSTPYEAFGQSAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAVDAIVIALTDPRMIQELAQANKRAYKQASDKMYLNLPLPFPDFSVAKIKAHLQTLVISHKQDHKHPEQARAQGGSIGQLHKDTNYGHIHGNVYATRIDLIVDEFSKRKNIDEIASRKIREAVMALFEPYADDEGKLKSSNKADYHHDLEAFKKQHDVKRVRIHQTRHNLIPICDSDGHAYRYVDGGNNFCAEIWMPNKGKQAGKWQCEIIRNFDVNQKNFLPKWRQENPTAMKVMRLQINDMVALDRDGKRVIFRVQKMGMNGQIFLRQHNDSRTEKSTEISFMASTLQSRNARKLFVSPTGKIYDPGRAKQPKQKG

SEQ ID NO: 5791 - protein, 1073 aa, unidentified
  REGION 1..1073: note = Description of Unknown:uncultivated organism
  REGION 1..1073: note = MG48-23 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLEKKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWSKIQKITGIKGVKFNLDELGRPGLQADTTSRAMMAAVPAWWLSLEDEQQRAVVDAVMTAQTDDDLKKQLDALFETLPADIPAALAKIRLPEGYGRISVEAAELLLPPLSQGMIYSDACQSVGINHSDDYDGVVYIKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAIDAIVIALTDPRMIQELAQANKRAYKQASDKMYLGLPLPFPDFSVAKIKERLQTLVISHKQDHKRPEQARAQGGSIGQLHEETNYGHIHDNVYATREDLNVEKFSNQSDIDEIASRKIREAVMALFEPYADDKGKLKSSNKADYHHDLEAFKKQHGVRRVRIHQTRHNLISIRDSDGHAYRYVVGGNNFCAEIWMPNKGKQADKWQCEIIRNFDINQKNFLPRWRQENPTAMKVMRLQINDMVALERNGERVICRVQKMYKSGEIILRHHNDSENAPKTQISTKASSLQSQNARKLFVSPTGKIYDPGRAKQPKRKD

SEQ ID NO: 5792 - protein, 1073 aa, unidentified
  REGION 1..1073: note = Description of Unknown:uncultivated organism
  REGION 1..1073: note = MG48-24 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLEKKLAIRLRKEDADERWTSRQMYRDEFERLMTAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWRKIQKITGIKGVKFNLDELGRPGLQADTTSRSMMAAAPAWWLSLEDEQQRAVVDAVMTAQTDDDLKKQLDALFETLPADIPAALAKIRLPEGYGRISIEAAELLLPPLSQGMIYSDACQSAGINHSDDYDGVVYTKGNLPFYGEVLQKHVIGGTHDVQQRENPEMYYGKINNPTVHMALNQFRRVLNELVQQYGCPPQEIHLELARETALSAKDLEILKKEQTHNKKNNDKINEILRKLGVAESYDNRMKYRLWEDLDNDPSGRCCPLSGKAISLDLLYSPQIEEEHIIPFSRSFDDSRNNKMVCFKSANFLKGNSTPYEAFGQSAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAVDAIVIALTDPRMIQELAQANKRAYKQASDKMYLNLPLPFPDFSVAKIKAHLQTLVISHKQDHKHPEQARAQGGSIGQLHKDTNYGHIHGNVYATRIDLIVDEFSKRKNIDEIASRKIREAVMALFEPYADDEGKLKSSNKADYHHDLEAFKKQHDVKRVRIHQTRHNLIPICDSDGHAYRYVDGGNNFCAEIWMPNKGKQAGKWQCEIIRNFDVNQKNFLPKWRQENPTAMKVMRLQINDMVALDRDGKRVIFRVQKMGMNGQIFLRQHNDSRTEKSTEISFMASTLQSRNARKLFVSPTGKIYDPGRAKQPKQKG

SEQ ID NO: 5793 - protein, 1057 aa, unidentified
  REGION 1..1057: note = Description of Unknown:uncultivated organism
  REGION 1..1057: note = MG48-25 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWSKIQKITGIKGVKFNLDELGRPGLQADTTSRAMMAAVPAWWLSLEDEQQRAVVDAVMTAQTDDDLKKQLDALFETLPADIPAALAKIRLPEGYGRISIEAAELLLPPLSQGMIYSDACQSAGINHSDDYDGVVYTKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRNNHHHHAIDAIVIALTDPRIIQELAQANKRAYKQASDKMYLNLPLPFPDFSVAKIKERLQTLVISHKQDHKRPEQARARGGSIGQLHDETNYGHIHDNVYATRIDLIVDKFSKRKNIDEIASRKIREAVMALFEPYADDKGELKSSNQADYHHDLEAFKEQYGVRRVRIHQTRHNLIPIRDSDGHAYRYVVGGNNFCAEIWMPNKGKQADKWQCEIIRNFDINQKNFLPRWRQENPTAMKVMRLQINDMVALERNGERVICRVQKMYKSGEIILRHHNDSENAPKTQISTKASSLQSQNARKLFVSPT

SEQ ID NO: 5794 - protein, 755 aa, unidentified
  REGION 1..755: note = Description of Unknown:uncultivated organism
  REGION 1..755: note = MG48-26 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWSKIQKITGIKGVKFNLDELGRPGLQADTTSRAMMAAVPAWWLSLEDEQQRAVVDAVMTAQTDDDLKKQLDALFETLPADIPAALAKIRLPEGYGRISIEAAELLLPPLSQGMIYSDACQSVGINHSDDYDGVVYIKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYDNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHH

SEQ ID NO: 5795 - protein, 1073 aa, unidentified
  REGION 1..1073: note = Description of Unknown:uncultivated organism
  REGION 1..1073: note = MG48-27 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWSKIQKITGIKGVKFNLDELGRPGLQADTTSRAMMAAVPAWWLSLEDEQQRAVVDAVMTAQTDDDLKKQLDALFETLPADIPAALAKIRLPEGYGRISIEAAELLLPPLSQGMIYSDACQSVGINHSDDYDGVVYIKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAIDAIVIALTDPRMIQELAQANKRAYKQASDKMYLGLPLPFPDFSVAKIKERLQTLVISHKQDHKRPEQARAQGGSIGQLHEETNYGHIHDNVYATREDLNVEKFSNQSDIDEIASRKIREAVMALFEPYADDKGKLKSSNKADYHHDLEAFKKQHGVRRVRIHQTRHNLISIRDSDGHAYRYVVGGNNFCAEIWMPNKGKQADKWQCEIIRNFDINQKNFLPRWRQENPTAMKVMRLQINDMVALERNGERVICRVQKMYKSGEIILRHHNDSENAPKTQISTKASSLQSQNARKLFVSPTGKIYDPGRAKQPKRKD

SEQ ID NO: 5796 - protein, 1073 aa, unidentified
  REGION 1..1073: note = Description of Unknown:uncultivated organism
  REGION 1..1073: note = MG48-28 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWSKIQKITGIKGVKFNLDELGRPGLQADTTSRAMMAAVPAWWLSLEDEQQRAVVDAVMTAQTDDDLKKQLDALFETLPADIPAALAKIRLPEGYGRISVEAAELLLPPLSQGMIYSDACQSVGINHSDDYDGVVYIKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAIDAIVIALTDPRMIQELAQANKRAYKQASDKMYLGLPLPFPDFSVAKIKERLQTLVISHKQDHKRPEQARAQGGSIGQLHEETNYGHIHDNVYATREDLNVEKFSNQSDIDEIASRKIREAVMALFEPYADDKGKLKSSNKADYHHDLEAFKKQHGVRRVRIHQTRHNLISIRDSDGHAYRYVVGGNNFCAEIWMPNKGKQADKWQCEIIRNFDINQKNFLPRWRQENPTAMKVMRLQINDMVALERNGERVICRVQKMYKSGEIILRHHNDSENAPKTQISTKASSLQSQNARKLFVSPTGKIYDPGRAKQPKRKD

SEQ ID NO: 5797 - protein, 1073 aa, unidentified
  REGION 1..1073: note = Description of Unknown:uncultivated organism
  REGION 1..1073: note = MG48-29 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWSKIQKITGIKGVKFNLDELGRPGLQADTTSRSMMAAVPAWWLSLEDEQQRAVVDAVMTAQTDDDLKKQLDALFETLPADIPAALAKIRLPEGYGRISIEAAELLLPPLSQGMIYSDACQSVGINHSDDYDGVVYIKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAIDAIVIALTDPRMIQELAQANKRAYKQASDKMYLGLPLPFPDFSVAKIKERLQTLVISHKQDHKRPEQARAQGGSIGQLHEETNYGHIHDNVYATREDLNVEKFSNQSDIDEIASRKIREAVMALFEPYADDKGKLKSSNKADYHHDLEAFKKQHGVRRVRIHQTRHNLISIRDSDGHAYRYVVGGNNFCAEIWMPNKGKQADKWQCEIIRNFDINQKNFLPRWRQENPTAMKVMRLQINDMVALERNGERVICRVQKMYKSGEIILRHHNDSENAPKTQISTKASSLQSQNARKLFVSPTGKIYDPGRAKQPKRKD

SEQ ID NO: 5798 - protein, 1073 aa, unidentified
  REGION 1..1073: note = Description of Unknown:uncultivated organism
  REGION 1..1073: note = MG48-30 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTPEITAEMRQKIIRYLCTDFSELRKDGILSWSKIQKITGIKGVKFNLDELGRPGLQADTTSRAMMAAVPAWWLSLEDEQQRAVVDAVMTAQTDDDLKKQLDALFETLPADIPAALAKVRLPEGYGRISVEAAELLLPPLSLGMIYSDACQSVGINHSDDYDGVVYIKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAIDAIVIALTDPRMIQELAQANKRAYKQASDKMYLGLPLPFPDFSVAKIKERLQTLVISHKQDHKRPEQARAQGGSIGQLHEETNYGHIHDNVYATREDLNVEKFSNQSDIDEIASRKIREAVMALFEPYADDKGKLKSSNKADYHHDLEAFKKQHGVRRVRIHQTRHNLISIRDSDGHAYRYVVGGNNFCAEIWMPNKGKQADKWQCEIIRNFDINQKNFLPRWRQENPTAMKVMRLQINDMVALERNGERVICRVQKMYKSGEIILRHHNDSENAPKTQISTKASSLQSQNARKLFVSPTGKIYDPGRAKQPKRKD

SEQ ID NO: 5799 - protein, 1055 aa, unidentified
  REGION 1..1055: note = Description of Unknown:uncultivated organism
  REGION 1..1055: note = MG48-31 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLHARLEKNAGLERKLAIRLRKEDADERWTSRQMYRDEFERLMAAQQVYHPQLLTDDVVTALRETIFHQRPLKEAKAGFCALLDGKMRARLAYPQIQRFRIYQEVNNLNTIKETPDTPEITAEMRQKIIRYLCTDFSELRKDGILSWSKIQKITGIKGVKFNLDELGRPGLQADTTSRAMMAAVPAWWLSLEDEQQRAVVDAVMTAQTDDDLKKQLDALFETLPADIPAALAKVRLPEGYGRISVEAAELLLPPLSLGMIYSDACQSVGINHSDDYDGVVYTKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEEEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAIDAIVIALTDPRMIQELAQANKRAYKQASDKMYLGLPLPFPDFSVAKIKERLQTLVISHKQDHKRPEQARAQGGSIGQLHEETNYGHIHDNVYATREDLNVEKFSNQSDIDEIASRKIREAVMALFEPYADDKGKLKSSNKADYHHDLEAFKKQHGVRRVRIHQTRHNLISIRDSDGHAYRYVVGGNNFCAEIWMPNKGKQADKWQCEIIRNFDINQKNFLPRWRQENPTAMKVMRLQINDMVALERNGERVICRVQKMYKSGEIILRHHNDSENAPKTQISTKASSLQSQNARKLFVW

SEQ ID NO: 5800 - protein, 1073 aa, unidentified
  REGION 1..1073: note = Description of Unknown:uncultivated organism
  REGION 1..1073: note = MG48-32 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLYARLEKNAGLEKKLAIRLRKEDADERWTSRQMYRDEFECLMTAQQVYHPQLLTDDVVTALRETIFHQRPLKEAKAGFCALLDGKMRARLAYPQIQRFRIYQEVNNLNTIKETPDTPEITAEMRQKIIRYLCTDFSELRKDGILSWSKIQKITGIKGVKFNLDELGRPGLQADTTSRSMMAAVPAWWLSLEDEQQRAVVDAVMTAQTDDDLKKQLDALFETLPADIPAALAKIRLPEGYGRISVEAAELLLPPLSQGMIYSDACQSAGINHSDDYDGVVYTKGNLPFYGEVLQKHVIGGTHDVQQRENAEMYYGKINNPTVHMALNQFRRVLNELVQQYGCPPQEIHLELARETALSAKDLDILKKEQTHNKKNNDKINEILRKLGVAESYDNRMKYRLWEDLDNDPSGRCCPLSGKAISLDLLYSPQIEVEHIIPFARSFDDSRNNKMVCFKSANFLKGDYTPYEAFGQSVQWPDILARAKKMSPDAHKGGKNASGFRVNKFWRFLPDAMEQLQGDAESFLARQLNDTKYMARVARRYAEYVAGKHYVLAIKGKFTSDLRHHWGLDELVGNFSDGQFKKDRNNHHHHAIDAIVIALTDPRIIQELAQANKRAYKQASDKMYLNLPLPFPDFSVAKIKERLQTLVISHKQDHKRPEQARARGGSIGQLHDETNYGHIHDNVYATRIDLIVDKFSKRKNIDEIASRKIREAVMALFEPYADDKGELKSSNQADYHHDLEAFKEQYGVRRVRIHQTRHNLIPIRDSDGHAYRYVVGGNNFCAEIWMPTKGKQAGKWQCEIIRNFDINQKNFLPKWRQENPTAMKVMRLQINDMVALERDGERVIFRVQKMGMNGQIFLRQHNDSRTEKSTEISFMASTLQSRNARKLFVSPTGKIYDPGRAKQPKRKG

SEQ ID NO: 5801 - protein, 1073 aa, unidentified
  REGION 1..1073: note = Description of Unknown:uncultivated organism
  REGION 1..1073: note = MG48-33 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLYARLEKNAGLEKKLAIRLRKEDADERWTSRQMYRDEFECLMTAQQVYHPQLLTDDVVTALRETIFHQRPLKEAKAGFCALLDGKMRARLAYPQIQRFRIYQEVNNLNTIKETPDTPEITAEMRQKIIRYLCTDFSELRKDGILSWSKIQKITGIKGVKFNLDELGRPGLQADTTSRSMMAAVPAWWLSLEDEQQRAVVDAVMTAQTDDDLKKQLDALFETLPADIPAALAKIRLPEGYGRISVEAAELLLPPLSQGMIYSDACQSAGINHSDDYDGVVYTKGNLPFYGEVLQKHVIGGTHDVQQRENAEMYYGKINNPTVHMALNQFRRVLNELVQQYGCPPQEIHLELARETALSAKDLDILKKEQTHNKKNNDKINEILRKLGVAESYDNRMKYRLWEDLDNDPSGRCCPLSGKAISLDLLYSPQIEVEHIIPFSRSFDDSRNNKMVCFKSANFLKGDYTPYEAFGQSVQWPDILARAKKMSPDAHKGGKNASGFRVNKFWRFLPDAMEQLQGDAESFLARQLNDTKYMARVARRYAEYVAGKHYVLAIKGKFTSDLRHHWGLDELVGNFSDGQFKKDRNNHHHHAIDAIVIALTDPRIIQELAQANKRAYKQASDKMYLNLPLPFPDFSVAKIKERLQTLVISHKQDHKRPEQARARGGSIGQLHDETNYGHIHDNVYATRIDLIVDKFSKRKNIDEIASRKIREAVMALFEPYADDKGELKSSNQADYHHDLEAFKEQYGVRRVRIHQTRHNLIPIRDSDGHAYRYVVGGNNFCAEIWMPTKGKQAGKWQCEIIRNFDINQKNFLPKWRQENPTAMKVMRLQINDMVALERDGERVIFRVQKMGMNGQIFLRQHNDSRTEKSTEISFMASTLQSRNARKLFVSPTGKIYDPGRAKQPKRKG

SEQ ID NO: 5802 - protein, 870 aa, unidentified
  REGION 1..870: note = Description of Unknown:uncultivated organism
  REGION 1..870: note = MG48-34 effector
MNYRLGFDLGYTSLGWACVLLDGQNHPCEVYDFGVRIFPSGRENKSKQPTSVERRKKRGARRNRDRYLARRTQLLAQMIAFGLQPPSKSERSELAKQEPLALRAKGINEPLTPFELGRALFHLNQRRGFQSNRIAERQGDEDESGLKKGIHALEGRLKEAQQTLGQYLYARLEKNAGLERKLAIRLRKEDADERWTSRQMYRDEFECLMTAQQVYHPQLLTDDVVTALRETIFHQRPLKEAKAGFCALLDGKMRARLAYPQIQRFRIYQEVNNLNTIKETPDTLEITAEMRQKIIRYLCTDFSELRKDGILSWSKIQKITGIKGVKFNLDELGRPGLQADTTSRSMMAVVPTWWLSLEDEQQRVVVDAVMTAQTDDDLKKQLDALFETLPADIPAALAKVRLPEGYGRISVEAAELLLPPLSLGMIYSDACQSVGINHSDDYDGVVYIKGNLPFYGEVLQKHVIGGTHDVQQRENAEMYYGKINNPTVHMALNQFRRVLNELVQQYGCPPQEIHLELARETALSAKDLAKLKTEQTNNKKNNDKINEILRKLGVAESYGNRMKYRLWEDLDNDPSGRCCPLSGKAISLDLLYSPQIEVEHIIPFSRSFDDSRNNKMVCFKSDNFLKGDYTPYEAFGHKAQWPDILARAKKMSPDAHKGGKNASGFRVNKFWRFLPDAMEQLQGDAESFLARQLNDTKYMARVARRYAEYVAGKHHVLAIKGKFTSDLRHHWGLDELVGNFSDGQFKKDRSNHHHHAIDAIVIALTDPRMIQELAQANKRAYKQASDKMYLGLPLPFPDFSVAKIKERLQTLVISHKQDHKRPEQARAQGGSIGQLHEETNYGHIHDNVYATREDLNVEKFSNQSDIDEIA

SEQ ID NO: 5803 - protein, 899 aa, unidentified
  REGION 1..899: note = Description of Unknown:uncultivated organism
  REGION 1..899: note = MG48-35 effector
MYKRQIRGKNEYEIYADRDMYESELRRIWDCQRKYHRNLTDEMLNEISGALFFQRPLKIPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGEINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 5804 - protein, 947 aa, unidentified
  REGION 1..947: note = Description of Unknown:uncultivated organism
  REGION 1..947: note = MG48-36 effector
RGFQSNRIAERQGDEDESGLKKGIHALEGRLKEAQQTLGQYLYARLEKNAGLEKKLAIRLRKEDADERWTSRQMYRDEFECLMTAQQVYHPQLLTDDVVTALRETIFHQRPLKEAKAGFCALLDGKMRARLAYPQIQRFRIYQEVNNLNTIKETPDTPEITAEMRQKIIRYLCTDFSELRKDGILSWSKIQKITGIKGVKFNLDELGRPGLQADTTSRSMMAAVPAWWLSLEDEQQRAVVDAVMTAQTDDDLKKQLDALFETLPADIPAALAKIRLPEGYGRISVEAAELLLPPLSQGMIYSDACQSAGINHSDDYDGVVYTKGNLPFYGEVLQKHVIGGTHDVQQRENAEMYYGKINNPTVHMALNQFRRVLNELVQQYGCPPQEIHLELARETALSAKDLDILKKEQTHNKKNNDKINEILRKLGVAASYDTRMKSRLWEDLDNDPSGRCCPLSGTALSLDLLYSPQIEVEHIIPFSRSFDDSRNNKMVCFKSANFLKGDYTPYEAFGQSVQWPDILARAKKMSPDAHKGGKNASGFRVNKFWRFLPDAMEQLQGDAESFLARQLNDTKYMARVARRYAEYVAGKHYVLAIKGKFTSDLRHHWGLDELVGNFSDGQFKKDRNNHHHHAIDAIVIALTDPRIIQELAQANKRAYKQASDKMYLNLPLPFPDFSVAKIKERLQTLVISHKQDHKRPEQARARGGSIGQLHDETNYGHIHDNVYATRIDLIVDKFSKRKNIDEIASRKIREAVMALFEPYADDKGELKSSNQADYHHDLEAFKEQYGVRRVRIHQTRHNLIPIRDSDGHAYRYVVGGNNFCAEIWMPTKGKQAGKWQCEIIRNFDINQKNFLPKWRQENPTAMKVMRLQINDMVALERDGERVIFRVQKMGMNGQIFLRQHNDSRTEKSTEISFMASTLQSRNARKLFVSPTGKIYDPGRAKQPKRKG

SEQ ID NO: 5805 - protein, 1068 aa, unidentified
  REGION 1..1068: note = Description of Unknown:uncultivated organism
  REGION 1..1068: note = MG49-1 effector
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAENKRNKGGDYSNTFLRSQLKEEIGIIFEKQKAFGSLYVTDAFSEKYLEILFSQRAFEEGPGGESPYAGNQIEKMVGKCPFEKEEKRASKATYTFELFNLWQKMNSIGILQDGIKRRLTDDERNKLFALCHKTEKVDYKRIRKELEMGQDALFSNLTYGRKEVEEVEAAKFQYLPVYHEMRKAFDKISKNHILQISNTQRDLIGTAITYYKTDDKIQQALLEGNFSKEEINAILGMKNFSKFGSLSVKAMQKVIPYLEKGLTYDKACEQAGYDFRAHSVAEKKKYLPKLPGDTYDITSPVVKRAINQTIKVVNEIIKRHGSPAAVNIELAREMSKSFKDRKRIEKEQNDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDIGEMKQRSLQDTQFITRFMMNYIKDYLLFDEAYDRKQRVTAVNGRVTAYMRKRWGINKVREDGDLHHSVDAVVVACITPGIVRTVTEYAKREENRYLNKDDAVMREKFPMPWPEFSTELDIRTCKEPKEMLRKVSLANYQDVDIDSIKPIFVSRMTKKKVTGQAHKETIRAYREVDGKMRTVTKTPIQELKLDKDGEIEGYYNPSSDILLYELLRSRLKEAGGNGKKAFPEGFVYKPTPNGGVAPKVKKVKIYDVSNLNIPVNHGVAANGNMVRIDLYYVEGEGYYFIPIYISDLIKKELPKKACVPHKEYHDWKNMKDEDFLYSIYPNDLLYIKSSTPKKFTKKKGEKKDSFEAEEAFVYYREAKISGATITVVTHDNNYTIQSLGVKTLSRIEKYHVDVLGNKYKAAVEERK

SEQ ID NO: 5806 - protein, 1090 aa, unidentified
  REGION 1..1090: note = Description of Unknown:uncultivated organism
  REGION 1..1090: note = MG49-2 effector
MYRIGLDIGIASVGWAVLETNSDGNPMRIIDLGSYVFDAAEDPKTGASLAKPRRDARGARRRLRRHKFRLQRIKKHIVRYGILSRDELEHLYDVPGEDIYRIRVEALDRALDDQEFARLLIHLAQRRGFRSNRRVDAKDQDEGKLLSAVNENARLMKERGYRTVGEMLYKDPKFSTAKRNKEESYSNTVSRSQMEDEVRRIFEAQRKCGNQKASEELEKEYLDIYLSQRSFEEGPGGNAGDYCPYSGNQIEKMVGHCTFEPDEKRAVKASYTFERANLLQNINKMQLIDENGEMYPLNEEQRHALVERAHQTASLDYSKIRKTLNLKETERFAYVDYNQKSTIENAEKKQKFEYLKHYHELRKALNSVEKDLIQKCPVQVRDEIGTILTYYKTDLKIRAALDKIEDPFLTEEVKDAVMGMSGCSGVGSLSLKALNNIMPYLEQGMMYDKAAEAAGYNFRGHDRYNKGMYLPTLSEDDDIRNPVVRRAVSQTIKVVNAIIKKYGKPVAINVELARETARTFEDRQKILKQQKKNREANQKTKRLLQEEFHLLSPSHLDILKDRLFKEQDGICLYSGEKIDRTRLFEDGYVQIDHIVPYSISWDDSYSNKVLVMTRENQQKGNRLPMEYLNGKKQDEFCVRVERQIRDLRKKTNLLMKSIPADKKESFKDRNLNDTKYICRFMLNYLNDHLLFDQSVDMGKRVTALNGSVTAYLRKRWGLNKVRGNGDKHHALDAVVIGCINNSLIMRVTQYFKHRENFLFEPEQHVQKKAEVPSPWPNFREEVEFRMADNPKAFYDRLSTKISLTNYSEEELEQVKPIFVSRMKVKKKTGSANDATIRGLKVLEDGQMVAISKVPLSTLRLDKNGEIKDYYHKEDDQLLYNALKDRLKEYGGSGEKAFTEPFYKPKANGDQGPLVRKVKTAKKITNGVVLNHGEGIASNGSMLRADFYRKNGKYYAVPVYVKDMVKDHLPDRAVTLKHPYDQWDKMDDNDFLFSLYPNDVVYIKFNVKNNKYQELHLVNKDSTLPEKKEFRELHGYYKSFDIATNSIKIITDDNCYYGKGIGIKTLPEIKKCAVDVLGNLIPVARETRKHR

SEQ ID NO: 5807 - protein, 1025 aa, unidentified
  REGION 1..1025: note = Description of Unknown:uncultivated organism
  REGION 1..1025: note = MG49-3 effector
GSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAENKRNKGGDYSNTFLRSQLREEIGIIFEKQKAFGSLYVTDAFSEKYLKILFSQRAFEEGPGEESPYAGNQIEKMVGKCTFEKEEKRASKATYTFELFNLWQKINSIGILQDGMKRRLTDDERNKLFALCHKAEKVDYKRIRKELELGQDALFSNLTYGRKEVEEVEAAKFQYLPVYHEMRRAFDKISKNHVLQISNTQRDLIGTAITYYKTDDKIQQALLEGNFSKEEINAILGMKNFSKFGNLSVKAMQKVIPYLEKGLTYDKACEQAGYDFRAHNVAEKKKYLPKLPQNTYDITSPVVKRAINQTIKVVNEIIKRHGSPAAVNIELAREMSKSFKDRKRIEKEQKDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIKDYLLFDEAYDRKQRVTAVNGRVTAYMRKRWGINKVREDGDLHHSVDAVVVACITPGIVQTVTEYAKREENRYLNKDDVAMRERFPMPWPEFSTELDIRTCKEPKEMLRKVSLANYQDVDIDSIKPIFVSRMTKKKVTGQAHKETIRAYREVDGKMRTVTKTSIQELKLDKDGEIEGYYNPSSDILLYELLRSRLKEAGGNGKKAFPEGFVYKPTPNGGVAPKVKKVKICAVSNLNIPVNHGVAANGDMVRIDLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIQSLGIKTLNCIEKYHVDVLGNKYKAAVEERK

SEQ ID NO: 5808 - protein, 1080 aa, unidentified
  REGION 1..1080: note = Description of Unknown:uncultivated organism
  REGION 1..1080: note = MG49-4 effector
MGYMLGLDCGIASVGHAVMLLDKNDEPFKIHSLGSRVFEAAEQLKTGASLALPRRMNRGLRRTTRRKQFRKERIKNLICSYMNVDLQYINDLYNVRGLTDIYEIRCKALDKPLDKGEFIRLLIHLSQRRGFRSNRKADSNDSKSDSGKLLKAVTENQELMQEKNYRTIGEMLYKDEKFLHKKRNDASGYSNTFSRSDYESEIKYIFNQQRTFRNIYATKEFEEKYLEIYLSQRMFDDGPGGGSPYRGNQIEKMVGKCTLEKDEPRAPKASFSFEYFNLLCKVNALKIATPSEKRFLTEIEKKCVIKLAFDKNNITYYHIRKALNLAENELFNISYKNDDYESTEKKTKFTYLSIYHQLKKAFGAAFAEWTISKKNDMASALTVNKYDAKISKCLKEKGFSETEIKIALTVPTFKKFGNLSIKALNKIIPFLEKGMIYSDAVQAAGYVPDSSENKLNKFLPAKAPELDDIVNPVVRRAVSQTIKIVNAVIREMGESPSYINIELARELSKNFKDRNEIKKEYNENYKFNEYIKERLVNEFHIISPGGQDIVKLKLWEQQDGICPYSGTKIEITRLFESGYAEIDHIIPYSKSFDDTYNNKILVKSAENRNKGNKLPLQYLYGVKAGKFRVWVENSNLSFRKKQNLLKEKISEDDKAFKDRNLQDTQYLSRFLLNYIKNYLEFSPNNKGRKNVVTSVNGKITSYVRKRWEIPKVRADGDMHHAVDAAVIACITPGMIQKITNYSKFTENENTVKINGKIKNADSETGEVFDRFPLPYPYFTKELIMRCSNNPTRILREKPFPNYCNDEVVNPIFVSRMPKRKVTGAAHEDTARKLVVENEISYLISKTDLKKLKLKNGEIDKYYNPEDDTLLYNALKQRLIEFNGDASKAFEEPFNKPKSDGTKGPLVKKVKLIERATSVVPIQGGTAYAKNDSIVRTDVFYIDGEGYYLVPIYVTDTIKSELPNKAIVAHKPYEQWKEMNDNDFLFSLYKNDLIKVISKKDMTFSLKNKESKLASTYSTKEEFVYFKSVNISSGAFTVINHDNSYSICSLGAKTLLSIEKYQVDFLGNKFKVNKERRQRFK

SEQ ID NO: 5809 - protein, 912 aa, unidentified
  REGION 1..912: note = Description of Unknown:uncultivated organism
  REGION 1..912: note = MG49-5 effector
MKEKGYRTVGEMLWKDERFAENKRNKGGDYSNTFLRSQLKEEIGIIFEKQKAFGSLYVTDAFSEKYLEILFSQRAFEEGPGEESPYAGNQIEKMVGKCTFEKEEKRAPKATYTFELYNLWQKINSIGILQDGVKRRLTDDERNKLFALCHKTEKIDYKRIRKELELGQDALFSNLTYGQKEVEEVEAAKFQYLPVYHEMRKAFDKISKNHVLQISNTQRDLIGTAITYYKTDDKIQQALLEGNFSKEEINAILGMKNFSKFGSLSVKAMQKVIPYLEKGLTYDKACEQAGYDFRAHNVAEKKKYLPKLPQNTYDITSPVVKRAINQTIKVVNEIIKRHGSPAAVNIELAREMSKSFKDRKRIEKEQKDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIKDYLLFDEAYDRKQRVTAVNGRVTAYMRKRWGINKVREDGDLHHSVDAVVVACITPGIVQMVTEYAKREENRYLNKDDVAMRERFPMPWPEFSTELDIRTCKEPKEMLQKVSLANYQDVDIDSIKPIFVSRMTKKKVTGQAHKETIRAYREVDGKMRTVTKTSIQKLELDKDGEIERYYNPSSDILLYELLRSRLKEAGGNGKEAFPEGFVYKPTPNGGVAPKVKKVKICAVSNLNIPVNHGVAANGDMVRIDLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIQSLGIKTLNCIEKYHVDVLGNKYKAAVEERK

SEQ ID NO: 5810 - protein, 1087 aa, unidentified
  REGION 1..1087: note = Description of Unknown:uncultivated organism
  REGION 1..1087: note = MG49-6 effector
MKYAVGLDIGISSVGYAVMMLDETDMPSAILKMGSRIFDAAENPKDGSSLAAPRRNNRGMRRRLRRKRFKKEQIKDLIVKNGIMSYSDINEIYNSGKVLSDIYSIRAEALNRILTKEEFVRLLIHLSQRRGFKSNRKVDASDSKSEAGKLLDAVNKNKSLMEEKHYRTIGEMLFIDEKFAKNKRNKAEDYANTFARSEYVAEINTIFDAQKVFGNEYAIDELKEDYLKIYLSQRSFDEGPGGNSPYSGNQIEKMLGKCTFEKKEFRAVKASFTFEYFSLLSKVNSLKLKSSTEKRFLTKAERDAVIALSFNKKNISYASIRKELNLPNDTLFNISYGNGDKTVEEIEKKSKFTYLNAYHTFKKAFGDSYINWSTDKKNHLGYAIALYKNDNKIAEYLSEHGFDKSEIKIALSLPSIPKAGNLSLKAMNKIIPYLEEGMIYNEACKAAGYNFKADETDKRMFLPANEEDAPELGDIRNPVVRRSISQTIKVTNAIIREFGESPCFVNIELARELSKTKKERNEIEKNQLENRNHNEEIVKELKSTFGLLQPTGQDIVKYKLWKEQNGICPYSLEPILIENLFDIGYTDIDHIIPYSISFDDTYNNKVLVLSSENRQKGNRIPMQYLTGKKKDDFWLWVDNSNLRARKKKNLLKEEITDDDISGFKKRNLQDTQYISRFMLNFLKKYLNTQPNSSGKKNTIIAVNGAATAYIRKRWGINKIRENGDTHHAVDAVVIACVTDSMIKKISEYSKHKETEFVHPETKEIKDIDLRTGEIINKFPMPYNWFRDELVMRTSNNPTRILHEKPLPNYGTDQKVEPIFVSRMPNHKVKGSAHEETIRKKYEEDNKTYSVSKVSLSSLKLTNGEIENYFNPSSDMLLYNALKQRLAMFGGNGSKAFEEPFYKPKSDGSQGPLVKKVKIQSKSTLSVPVLKGTAIADNGSMVRVDVFFVEGEGYYMVPIYVSDTVKPELPNKAIIANKPYTEWKEMKEQDFLFSLYPNDLIRIKFNKEKQFSLVQKDSTLAKNLLLSEGYFYYKKASISSASITIINNDNTYTVASLGVKRIPLIEKYQVDVLGNIQKVGKEKRMRFR

SEQ ID NO: 5811 - protein, 1117 aa, unidentified
  REGION 1..1117: note = Description of Unknown:uncultivated organism
  REGION 1..1117: note = MG49-7 effector
MRYGIGLDIGIASVGSAIVLLDGNGEPNKIHRLASRIFDAAEVPKTGAPLAQERREKRGMRRRCRRKRHRKKRIRALICKSLDVDNDYIENIFAETGLSNIYQIRCEALDRALTKDESIRLLIHFSQRRGFRSNRKVDAASDNDEGALLSAVSENKKLMELKKYRTIGETLYRDDKFAEFKRNKGGDYTNTFSRADYKNEIETVFAAQREMGNSLFTEELEAGFKDIVFSQRSFDEGPGPGKDSIYSGNQIEKMLRKCTFEPDEYRAPKASFTFEYFNLQSKINALKIVSDSGKRSLTKEERDAVRDLAFSQKEITYSSVRKALKLSNQEMFNISYFLSDDKKKKTGDENPFELRDSVEKKIKFNYLKAYHIFKKAYGEEYDTWDSEKRDILAYVLTVFKTDSKIRDNLAENGFNEEEINIALTIPSFSKFGNLSCKAMRKMIPYLEEGYLYNEAAEKAGYNFKADDKCASMYLPTRAYIRPEHRKSPDQVEAPELGDITNPVVRRAVSQTIKVVNAIIREMGCSPTYVNIELARDLSKNHDERNRILKRNNDNKAQNEKIMDELRKEFKFGNPRKSDLLKLKLWTEQHGRCMYSGEPIIRERLFEDNYAEIDHIVPYSISFDDSMANKVLVLAKENRDKGNRLPLEYLKGKDADDFRIRITTSTLKYRKKQNLLKEKITKDDEEGFKQRNLVDTQYISRFMTKFIKKYLKFEGEPKVVSVAGGVTSYIRKRWGIKKIREDGDTHHAIDACVIACTTQGMVQRIALYSKYRETEYMDENGNYFDVDRKTGEVINRFPMPYPTFRKELEMLSSNDPRRILSEKPLPNYDGSEQLKPIFVSRMPKRKATGKVHEDTVRTLYRHNGVEYSIQKVALEELKLDKKTNKIVSDTSEYYNPDSDRLLYSALKRRLEEFDGDGKKAFTEPFHKPKSDGSDGPIVKKVKMIKRITSYVLLNGENIGKKEIAENGKRVRTDVFYVEGEGYYFVPIYVDDTLKKDLPDRAIVQRKPMKEWKQMDDKNFIFSLYPDDLVKIVFPNNKTFKIKKELAKAGSTLPKEIVLKEGLFYYQGVNISSGNITVESNDGTYYSEPGPRKLISLEKYEVDVLGNIHKVNKEKRMGF

SEQ ID NO: 5812 - protein, 1117 aa, unidentified
  REGION 1..1117: note = Description of Unknown:uncultivated organism
  REGION 1..1117: note = MG49-8 effector
MRYGIGLDIGIASVGSAIVLLDGNGEPNKIHRLASRIFDAAEVPKTGAPLAQERREKRGMRRRCRRKRHRKKRIRALICKSLDVDNDYIENIFAETGLSNIYQIRCEALDRALTKDESIRLLIHFSQRRGFRSNRKVDAASDNDEGALLSAVSENKKLMELKKYRTIGETLYRDDKFAEFKRNKGGNYTNTFSRADYKNEIETVFAAQREMGNSLFTEELEAGFKYIVFSQRSFDEGPGPGKDSIYSGNQIEKMLRKCTFEPDEYRAPKASFTFEYFNLQSKINALKIVSDSGKRSLTKEERDAVRDLAFSQKEITYSSVRKALKLSNLEMFNISYILSDDKKKKTGDENPFELRDSVEKKIKFNYLKAYHIFKKAYGEEYDTWDSEKRDILAYVLTVFKTDSKIRDNLAENGFNEEEINIALTIPSFSQFGNLSCKAMRKMIPYLEEGYLYNEAAEKAGYNFKADDKCASMYLPTRAYIRPEHRKSPDQVEAPELGDITNPVVRRAVSQTIKVVNAIIREMGCSPTYVNIELARDLSKNHDERNRILKRNNDNKAQNERIMDELRKEFKFGNPRKSDLLKLKLWTEQHGRCMYSGEPIIRERLFEDNYAEIDHIVPYSISFDDSMANKVLVLAKENRDKGNRLPLEYLKGKDADDFRIRITTSTLKYRKKQNLLKEKITKDDEEGFKQRNLVDTQYISRFMTKFIKKYLKFEGEPKVVSVAGGVTSYIRKRWGIKKIREDGDTHHAIDACVIACTTQGMVQRIALYSKYRETEYMDENGNYFDVDRKTGEVINRFPMPYPTFRKELEMLSSNDPRRILSEKPLPNYDGSEQLKPIFVSRMPKRKATGKVHEDTVRTLYRHNGVEYSIQKVALEELKLDKKTNKIVSDTSEYYNPDSDRLLYSALKRRLEEFDGDGKKAFTEPFHKPKSDGSDGPIVKKVKMIKRITSYVLLNGENIGKKEIAENGKRVRTDVFYVEGEGYYFVPIYVDDTLKKDLPDRAIVQRKPMKEWKQMDDKNFIFSLYPDDLVKIVFPNNKTFKIKKELAKAGSTLPKEIVLKEGLFYYQGVNISSGNITVESNDGTYYSEPGPRKLISLEKYEVDVLGNIHKVNKEKRMGF

SEQ ID NO: 5813 - protein, 1120 aa, unidentified
  REGION 1..1120: note = Description of Unknown:uncultivated organism
  REGION 1..1120: note = MG49-9 effector
MRYGIGLDIGISSVGSCIIQLDEKNEPYKILKLYSRVYYKAEKSDGKSLATERRNNRSIRRVIRRKRHRKERIRTLICNRMNVDNSYIDRIFAFDKLTDIYMIRCEALDRLLDINEFIRLLIHFSQRRGFKSNRKAEAKNAEKESEDGVMLSAVKENHELMKEKGYRTIGEMIFRDQKFSGSIRNKGGSYSHTFLRSDYENEIHLIFRMQRAFLNQYADEEFENKYMEILMSQRSFDEGPGGGKYAGNQIEKMLRKCTFEPNEYRAPKASFSFQYFTLLSKINSIRIQTNSGRRYLSENERISIKKLAFDQKEINYSSLRKLLKLSDEETFNISYFLKTSSEKTSSKKKVPDVLTDFVKMRDKVETKTKFNFLKEYHVFKSVYGNEYDFWENDKKNKLAYVLTVYKTDEKIKAQLEALGFTEEEIAKAMTIQSFAKFGNLSCKAMDKMIPYLEEGYLYNEAADKAGYNFKADEKCASMYLPTRSYILPEHRKSVDQVCAPELDNIVNPVVRRAVSQTIKVVNAIIREMKDSPVYVNVEMARELSKSYNERLKIEKEQQKNKSRNDSVIDKLRSDFQIVSPTGQDIMKLKLWEDQQGLCMYSGRKIPVNRLFESGFTEVDHIVPYSISFDDSYNNKVLVLATENQNKSDRLPLQYLRDNKADEFRVRVETSSLNIRKKQNLLKEKITDEDYTGFKERNLKDTQYISRFMKNYIEKYLLFAEKPKVTAVNGAITSYIRKRWGIRKIRSDGDTHHAIDACVIACVTQGMIQKISVYSKYKEKGKKSQQFIEYTNTTGTLYDVDSSTGEIVDRFPMPYPTFRKELEMLTSKDPMKVLCESNLPNYTGNEQLTPIFVSRMVKHKVTGAAHKDTKQSLKKKDGKSFAVQKVDLANLKFDKKTGEIINYYNPQDDALLYAALIRRLKEFDGNAKKAFEEPFFKPKKDGSQGPLVKKVKIIEKSTLSVPLDNGNAIAGNDSMVRVDVFYINGEGYYLVPVYEVDTVKKILPNKAIVPNKSYEEWKIMSDENFVFSLYPNDLIAIKSNKKMTFSLDNKNSTLPEKYVSTFELVYYRNTGISTASINVINHDKTYVKKSLGVKNLMKIEKYSVDVLGNITKVGREKRRGF

SEQ ID NO: 5814 - protein, 1094 aa, unidentified
  REGION 1..1094: note = Description of Unknown:uncultivated organism
  REGION 1..1094: note = MG49-10 effector
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAENKRNKGGDYSNTFLRSQLKEEIGIIFEKQKAFGSLYVTDAFSEKYLEILFSQRAFEEGPGEESPYAGNQIEIMVGKCTFEKEEKRASKATYTFELFNLWQKMNSIGILQDGIKRRLTDDERNKLFALCHKTEKVDYKRIRKELEMGQDALFSNLTYGRKEVEEVEAAKFQYLPVYHEMRKAFDKISKNHILQISNTQRDLIGTAITYYKTDDKIQQALLEGNFSKEEINAILGMKNFSKFGSLSVKAMQKVIPYLEKGLTYDKACEQAGYDFRAHNVAEKKKYLPKLPQNTYDITSPVVKRAINQTIKVVNEIIKRHGSPAAVNIELAREMSKSFKDRKRIEKEQKDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIRDYLLFDEAYDRKQRVTAVNGRVTAYMRKRWGINKVREDGDLHHSVDAVVVACITPGIVQMVTEYAKREENRYLNKDDVAMRERFPMPWPEFSTELDIRTCKEPKEMLRKVSLANYQDVDIDSIKPIFVSRMTKKKVTGQAHKETIRAYREVDGKMRTVTKTSIQELKLDKDGEIEGYYNPSSDILLYELLRSRLKEAGGNGKKAFPEGFVYKPTPNGGVAPKVKKVKICAVSNLNIPVNHGVAANGDMVRIDLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNCIEKYHVDVLGNKYKAAVGRGNNGRCQRVGEQVRTRFLYHHLLKSI

SEQ ID NO: 5815 - protein, 1070 aa, unidentified
  REGION 1..1070: note = Description of Unknown:uncultivated organism
  REGION 1..1070: note = MG49-11 effector
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAENKRNKGGDYSNTFLRSQLKEEIGIIFEKQKAFGSLYVTDAFSEKYLEILFSQRAFEEGPGEESPYAGNQIEKMVGKCTFEKEEKRASKATYTFELFNLWQKINSIGILQDGVKRRLTDDERNKLFALCHKTEKIDYKRIRKELEMGQDALFSNLTYGRKEVEEVEAAKFQHLPVYHEMRKAFDKISKNHVLQISNTQRDLIGTAITYYKTDDKIQQALLEGNFSKEETNAILGMKNFSKFGNLSVKAMQKVIPYLEKGLTYDKACEQAGYDFRAHNVAEKKKYLPKLPQNTYDITSPVVKRAINQTIKVVNEIIKRHGSPAAVNIELAREMSKAFRDRKRIEKEQKDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIRDYLLFDEAYDRKQRVTAVNGRVTAYMRKRWGINKVREDGDLHHSVDAVVVACITPGIVQMVTEYAKREENRYLNKDDVAMRERFPMPWPEFSTELDIRTCKEPKEMLRKVSLANYQDVDIDSIKPIFVSRMTKKKVTGQAHKETIRAYREVDGKMRTVTKTSIQELKLDKDGEIEGYYNPSSDILLYELLRSRLKEAGGNGKKAFPEGFVYKPTPNGGVAPKVKKVKICAVSNLNIPVNHGVAANGDMVRIDLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNCIEKYHVDVLGNKYKAAVEERK

SEQ ID NO: 5816 - protein, 1070 aa, unidentified
  REGION 1..1070: note = Description of Unknown:uncultivated organism
  REGION 1..1070: note = MG49-12 effector
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAENKRNKGGDYSNTFLRSQLREEIGIIFEKQKAFGSLYVTDAFSEKYLEILFSQRAFEEGPGEESPYAGNQIEKMVGKCTFEKEEKRASKATYTFELFNLWQKINSIGILQDGVKRRLTDDERNKLFALCHKTEKIDYKRIRKELELGQDALFSNLTYGQKEVEEVEAAKFQYLPVYHEMRKAFDKISKNHVLQISNTQRDLIGTAITYYKTDDKIQQALLEGKFSKEEINAILGMKNFSKFGSLSVKAMQKVIPYLEKGLTYDKACEQAGYDFRAHNVAEKKKYLPKLPQNTYDITSPVVKRAINQTIKVVNEIIKRHGSPAAVNIELAREMSKSFKDRKRIEKEQNDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIRDYLLFDEAYDRKQRVTAVNGRVTAYMRKRWGINKVREDGDLHHSVDAVVVACITPGIVQTVTEYAKREENRYLNKDDVAMRERFPMPWPEFSTELDIRTCKEPKEMLRKVSLANYQDVDIDSIKPIFVSRMTKKKVTGQAHKETIRAYREVDGKMRTVTKTSIQELKLDKDGEIEGYYNPSSDILLYELLRSRLKEAGGNGKKAFPEGFVYKPTPNGGVAPKVKKVKICAVSNLNIPVNHGVAANGDMVRIDLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNCIEKYHVDVLGNKYKAAVEERK

SEQ ID NO: 5817 - protein, 1070 aa, unidentified
  REGION 1..1070: note = Description of Unknown:uncultivated organism
  REGION 1..1070: note = MG49-13 effector
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAGNKRNKGGDYSNTFLRSQLKEEIGIIFEKQKAFGSLYVTDAFSEKYLEILFSQRAFEEGPGEESPYAGNQIEKMVGKCTFEKEEKRAPKATYTFELYNLWQKINSIGILQDGVKRRLTDDERNKLFALCHKTEKIDYKRIRKELELGQDALFSNLTYGQKEVEEVEAAKFQYLPVYHEMRKAFDKISKNHVLQISNTQRDLIGTAITYYKTDDKIQQALLEGNFSKEEINAILGMKNFSKFGSLSVKAMQKVIPYLEKGLTYDKACEQAGYDFRAHSVAEKKKYLPKLPQNTYDITSPVVKRAINQTIKVVNEIIKRHGSPAAVNIELAREMSKSFKDRKRIEKEQKDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIKDYLLFDEAYDRKQRVTAVNGRVTAYMRKRWGINKVREDGDLHHSVDAVVVACITPGIVQMVTEYAKREENRYLNKDDVAMRERFPMPGPEFSTELDIRTCKEPKEMLRKGSLANYQDVDIDSIKPIFVSRMTKKKVTGQAHKETIRAYREVDGKMRTVTKTSIQELKLDKDGEIEGYYNPSSDILLYELLRSRLKEAGGNGKKAFPEGFVYKPTPNGGVAPKVKKVKICAVSNLNIPVNHGVAANGDMVRIDLYYVEGEGYYFIPIYISDLMKEELPKKACVSNKEYHDWKNMKDEDFLYSIYPNDLLRIKSSTPKKFTKNIQKGKENDSFEAEEAFVYYIKAGIGTGSITVVTHDNNYTIQSLGIKTLNCIEKYHVDVLGNKYKAAVEERK

SEQ ID NO: 5818 - protein, 1070 aa, unidentified
  REGION 1..1070: note = Description of Unknown:uncultivated organism
  REGION 1..1070: note = MG49-14 effector
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAGNKRNKGGDYSNTFLRSQLREEIGIIFEKQKAFGSLYVTDAFSEKYLEILFSQRAFEEGPGEESPYAGNQIEKMVGKCTFEKEEKRASKATYTFELFNLWQKINSIGILQDGVKRRLTDDERNKLFALCHKTEKIDYKRIRKELELGQDALFSNLTYGQKEVEEVEAAKFQYLPVYHEMRKAFNKISKNHVLQISNTQRDLIGTAITYYKTDDKIQQALLEGNFSKEEINAILGMKNFSKFGSLSIKAMQKVIPYLEKGLTYDKACEQAGYDFRAHSVAEKKKYLPKLPGDTYDITSPVVKRAINQTIKVVNEIIKRHGSPAAVNIELAREMSKSFKDRKRIEKEQNDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVANKEEYEIRVNTLIKNRAKREKLLKPILTEEDMGEMKQRSLQDTQFITRFMMNYIRDYLLFDEAYDRKQRVTAVNGRVTAYMRKRWGINKVREDGDLHHSVDAVVVACITPGIVQMVTEYAKREENRYLNKDDVAMRERFPMPWPEFSTELDIRTCKEPKEMLRKVSLANYQDVDIDSIKPIFVSRMTKKKVTGQAHKETIRAYREVDGKMRTVTKTSIQELKLDKDGEIEGYYNPSSDILLYELLRSRLKEAGGNGKKAFPEGFVYKPTPNGGVAPKVKKVKICAVSNLNIPVNHGVAANGDMVRIDLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNCIEKYHVDVLGNKYKAAVEERK

SEQ ID NO: 5819 - protein, 1070 aa, unidentified
  REGION 1..1070: note = Description of Unknown:uncultivated organism
  REGION 1..1070: note = MG49-15 effector
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNKKYLKEKGYRTVGEMLWKDERFAENKRNKGGDYSNTFLRSQLREEIGIIFEKQKAFCSLYVTDAFSEKYLEILFSQRAFEEGPGEESPYAGNQIEKMVGKCTFEKEEKRASKATYTFELFNLWQKINSIGILQDGMKRRLTDDERNKLFALCHKAEKVDYKRIRKELELGQDALFSNLTYGRKEVEEVEAAKFQYLPVYHEMRRAFDKISKNHVLQISNTQRDLIGTAITYYKTDDKIQQALLEGNFSKEEINAILGMKNFSKFGNLSVKAMQKVIPYLEKGLTYDKACEQAGYDFRAHNVAEKKKYLPKLPQNTYDITSPVVKRAINQTIKVVNEIIKRHGSPAAVNIELAREMSKSFRDRKRIEKEQNDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVANKEEYEIRVNTLIKNRAKREKLLKPILTEEDMGEMKQRSLQDTQFITRFMMNYIKDYLLFDEAYDRKQRVTAVNGRVTAYMRKRWGINKVREDGDLHHSVDAVVVACITPGIVQTVTEYAKREENRYLNKDDVAMRERFPMPWPEFSTELDIRTCKEPKEMLRKVSLANYQDVDIDSIKPIFVSRMTKKKVTGQAHKETIRAYREVDGKMRTVTKTSIQELKLDKDGEIEGYYNPSSDILLYELLRSRLKEAGGNGKKAFPEGFVYKPTPNGGVAPKVKKVKICAVSNLNVSVNHGVAANGDMVRIDLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNFIEKYHVDVLGNKYKAAVEERK

SEQ ID NO: 5820 - protein, 1068 aa, unidentified
  REGION 1..1068: note = Description of Unknown:uncultivated organism
  REGION 1..1068: note = MG49-16 effector
MYRLGLDIGTTSVGAAILNIDHYGEPNRIIDMHVRTFEAAENTKDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATAENEKYLKEKGYRTVGEMLWKDERFAGNKRNKGGDYSNTFLRSQLKEEIGIIFERQKAFGSLYVTDAFSEKYLEILFSQRAFEEGPGEESPYAGNQIEKMVGKCTFEKEEKRASKATYTFELFNLWQKMNSIGILQDGIKRRLTDDERNKLFALCHKMEKVDYKRIRKELEMGQDALFSNLTYGRKEVEEVEAAKFQYLPVYHEMRKAFDKISKNHILQISNTQRDLIGTAITYYKTDDKIQQALLEGNFSKEEINAILGMKNFSKFGSLSVKAMQKVIPYLEKGLTYDKACEQAGYDFRAHSVAEKKKYLPKLPQNTYDITSPVVKRAINQTIKVVNEIIKRHGSPSAVNIELAREMSKSFKDRKRIEKEQKDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIKDYLLFDEAYDRKQRVTAVNGRVTAYMRKRWGINKVREDGDLHHSVDAVVVACITPGIVQMVTEYAKREENRYLNKDDVAMRERFPMPWPEFSTELDIRTCKEPKEMLQKVSLANYQDVDIDSIKPIFVSRMTKKKVTGQAHKETIRAYREVDGKMRTVTKTSIQKLGLDKDGEIERYYNPSSDILLYELLRSRLKEAGGNGKEAFPEGFVYKPTPNGGVAPKVKKVKIYDVSNLNIPVNHGVAANGKMVRIDLYYVEGEGYYFIPIYISDLMKEELPKKACVPHKEYHDWKNMKDEDFLYSIYPNDLLYIKSSTPKKFAKKRGEKKDFFEAEEAFVYYREAGISGATITVETHDNNYTIQSLGVKTLSRIEKYYVDVLGNKYKAAVEERK

SEQ ID NO: 5821 - protein, 833 aa, unidentified
  REGION 1..833: note = Description of Unknown:uncultivated organism
  REGION 1..833: note = MG49-17 effector
TFEYFNLQSKINALKIVSDSGKRSLTKEERDAVRDLAFSQKEITYSSVRKALKLSNQEMFNISYILSDDKKKKTGDENPFELRDSVEKKIKFNYMKAYHIFKKAYGEEYDTWDSEKRDILAYVLTVFKTDSKIRDNLAENGFNEEEINIALTIPSFSKFGNLSCKAMRKMIPYLEEGYLYNEAAEKAGYNFKADDKCASMYLPTRAYIRPEHRKSPDQVEAPELGDITNPVVRRAVSQTIKVVNAIIREMGCSPTYVNIELARDLSKNHDERNRILKRNNDNKAQNERIMDELRKEFKFGNPRKSDLLKLKLWTEQQGRCMYSGEPIIRERLFEDNYAEIDHIVPYSISFDDSMANKVLVLAKENRDKGNRLPLEYLKGKDADDFRIRITTSTLKYRKKQNLLKEKLTKDDEEGFKQRNLVDTQYISRFMTKFIKKYLKFEGEPKVVSVAGGVTSYIRKRWGIKKIREDGDTHHAIDACVIACTTQGMVQRIALYSKYRETEYMDENGNYFDVDRKTGEVINRFPMPYPTFRKELEMLSSNDPRRILSEKPLPNYDGSEQLKPIFVSRMTNRKVTGQAHEETLRKPVIENGQNYVVQKVPLTSLKLDKNGEIENYYMPQSDRLLYEALKARLAEFGGKGEKAFTEPFYKPKSDGTQGPLVKKVKTIEKRSISVPLADGTAAADNGSMVRVDVFYVEGEGYYLVPIYVADTVKKELPNRAITRDRSYIDWKVMDDKKFIFSLYPNDLIKVTSKKDMKFSLVRNESTLPKEHTTKAEYVYYKKTSISTGSITVINHDKTYLINSLGVKTLLSIEKYEVDVLGNIHKVNKEKRMGF

SEQ ID NO: 5822 - protein, 902 aa, unidentified
  REGION 1..902: note = Description of Unknown:uncultivated organism
  REGION 1..902: note = MG49-18 effector
VGEMLWKDERFAENKRNKGGDYSNTFLRSQLKEEIGIIFEKQKAFGSLYVTDAFSEKYLEILFSQRAFEEGPGEESPYAGNQIEKMVGKCTFEKEEKRAPKATYTFELYNLWQKINSIGILQDGVKRRLTDDERNKLFALCHKTEKIDYKRIRKELELGQDALFSNLTYGQKEVEEVEAAKFQYLPVYHEMRKAFNKISKNHVLQISNTQRDLIGTAITYYKTDDKIQQALLEGNFSKEEINAILGMKNFSKFGSLSIKAMQKVIPYLEKGLTYDKACEQAGYDFRAHSVAEKKKYLPKLPGDTYDITSPVVKRAINQTIKVVNEIIKRHGSPAAVNIELAREMSKSFKDRKRIEKEQNDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVANKEEYEIRVNTLIKNRAKREKLLKPILTEEDMGEMKQRSLQDTQFITRFMMNYIRDYLLFDEAYDRKQRVTAVNGRVTAYMRKRWGINKVREDGDLHHSVDAVVVACITPGIVQMVTEYAKREENRYLNKDDVAMRERFPMPWPEFSTELDIRTCKEPKEMLQKVSLANYQDVDIDSIKPIFVSRMTKKKVTGQAHKETIRAYREVDGKMRTVTKTSIQKLELDKDGEIERYYNPSSDILLYELLRSRLKEAGGNGKEAFPEGFVYKPTPNGGVAPKVKKVKIYAVSNLNIPVNHGVAANGAMVRIDLYYVEGEGYYFIPIYISDLMKEELPKKACVPHKEYHDWKNMKDEDFLYSIYPNDLLYIKSSTPKKFAKKRGEKKDSFEAEEAFVYYREAGISGATITVETHDNNYTIQSLGVKTLSRIEKYHVDVLGNKYKAAVEERK

SEQ ID NO: 5823 - protein, 902 aa, unidentified
  REGION 1..902: note = Description of Unknown:uncultivated organism
  REGION 1..902: note = MG49-19 effector
VGEMLWKDERFAGNKRNKGGDYSNTFLRSQLKEEIGIIFEKQKAFGSLYVTDAFSEKYLEILFSQRAFEEGPGEESPYAGNQIEKMVGKCTFEKEEKRASKATYTFELFNLWQKINSIGILQDGMKRRLTDDERNKLFALCHKAEKVDYKRIRKELELGQDALFSNLTYGRKEVEEVEAAKFQYLPVYHEMRRAFDKISKNHVLQISNTQRDLIGTAITYYKTDDKIQQALLEGKFSKEEINAILGMKNFSKFGSLSVKAMQKVIPYLEKGLTYDKACEQAGYDFRAHSVAEKKKYLPKLPEDTYDITSPVVKRAINQTIKVVNEIIKRHGSPAAVNIELAREMSKSFKDRKRIEKEQKDNAAQNQRIYDEIKDTFHVVQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDMGEMKQRSLQDTQFITRFMMNYIKDYLLFDEAYDRKQRVTAVNGRVTAYMRKRWGINKVREDGDLHHSVDAVVVACITPGIVQTVTEYAKREENRYLNKDDVAMRERFPMPWPEFSTELDIRTCKEPKEMLQKVSLANYQDVDIDSIKPIFVSRMTKKKVTGQAHKETIRAYREVDGKMRTVTKTSIQELKLDKDGEIEGYYNPSSDILLYELLRSRLKEAGGNGKEAFPEGFVYKPTPNGGVAPKVKKVKIYAVSNLNIPVNHGVAANGAMVRIDLYYVEGEGYYFIPIYISDLMKEELPKKACVPHKEYHDWKNMKDEDFLYSIYPNDLLYIKSSTPKKFAKKRGEKKDSFEAEEAFVYYREAKISGAAITVETHDNNYTIQSLGVKTLSRIEKYHVDVLGNKYKAAVEERK

SEQ ID NO: 5824 - protein, 1074 aa, unidentified
  REGION 1..1074: note = Description of Unknown:uncultivated organism
  REGION 1..1074: note = MG50-1 effector
MNTSDKEISRQYVLGLDIGIASTGWAVLNSDDGSTVDGIIDLGVRTFERGETAKEGESLNLARRLARGTRRRLRRRAHRMLRLKRLLLREGLIKHDQLDTSGNIKFSADPWRLRSDGLDRLLTPVEWAEVIYHIIKHRGYLSTRKADKNTSDDDTGKVLVALKYMNERLQNGGWRTIGEMAYKDDVEFGHSIRNKQGDYRHCFDRKMLMKELQLLAVKQREYGNPHTDDAFVDQITTLLMQQRPALSGKNLLKMLGKCTFEKHEYRAPRSSYSAERFVWLTKLNNLRLLNSDRTRRALTAAERRTIIDMPYERSTVKYAQVRKILDLPDDVLFVGLRYRDDKNAENEKLIELKSWHKLKKTLTDAGLKTEWQGIATRPDELDKLAYALSVFKDDKEITDYLRAEGFDDAIIDALLPVSFSKFSHLSLLALRKLMPHLEAGMRYDEACTEAGYDHSLPVNIDQSELLPPINPEDVRNPVVLRSLTQARKVINAIVREYGQPLRVHIELARDLSRPKSERNRIEREQKKWRDHKEGLVKEYVENLGTEPSGKDLLKYRLYKEQNGKCAYSLQPLMLDRLTEAGYADIDHILPYSRTFDDSLNNKVLVLGKENRNKGNKTPWEYFGSSNEPHWLLYEAWVKSNPGFKQAKRNRLLKRSLTAEDQQDFRERHLNDTRYIARYLKNFVEQYLQLSAGAQRVRVVSGSLTSFLRARYGLIKHRKESDLHHAMDAVVVAAATNSMIKRLSDYARFDELEHVKVAGFVDPETGEVLDISTLRKLEQQFPEPWPHFRQELEARLKPDPQRALQGIEGWRHRDVSWIRPVTVSRAPRRGVTGPGHAETIRSAKRLDEQISYTRVPLSRLTLPMLEKMHGRERDKPLYEALKARLAEHGGKADKAFAEPFYKPAAPGKQAPRVTAIKIETTQKSGLPIRNGVADATSMVRVDVYRKNSKYCMVPVYAWQIERDIIPRHAVNAYKRESEWELMDETAKYLYHFQFDDLIQVDTGKSKIAGYFNGFDRSTGAIHIEVHDRNLKQGKNGLFRSIGVKSAKSLQKFQIDVLGRYWPIDKEVPPWAGAAS

SEQ ID NO: 5825 - protein, 842 aa, unidentified
  REGION 1..842: note = Description of Unknown:uncultivated organism
  REGION 1..842: note = MG50-2 effector
KDESLKAAAQTAGEQIDAIAEVLTKAQTDADVEKGLATLGLTENQIGALERLRFKQYRNLSLKALRKILPGLEAKKSYTEACKNAGYEPLTRQRSKHLPPREPYLYDRPRHGKKTGYKELRYRDLTNPVVARAFNQARLVFNALIDRYDQSPAYVHVELSRDLAKSKERRDEDKRRQDENRRIRSVARENIKETYRLDTPTERQILKERLYHEQQCKCLYTLTELDSHRVVHDENYAQIDHIWPRSLTFDNSRDNLVLVHAHANQNKGNRIPYDFIMQEKGAEHWRNVEKWILSCKGMSDNKQKRLLAKELDADEFLARNLVDTRYATRLFARMIRDRLLFDGQLEDKIEDIDPSESGKSRLEKFHKTRVRTPQGALTALLRRSWLGDIKNRETSDRHHALDACIVAACTPDLIHKVNSYFANEEKIPNRFQKNADGTYRDRCSGEIISKPEARERGLFLPPPWDGFRKEFREKYDLIMVSRAVRKKRRGELHDANPFAFRKLSVPLTDLSSEILTSHSMPEGFRKKHYELLLGLARQLENHGGDAGVAFPGPYEFLDRNGNQQRIQSISLPVVSLPEAYLKQRLKRSPKNKTVPENDRVAHKVVRLIDLNLRKLDPRTLGVGYYQRNKKLIDALRERLTEFGGNAKKAFGTEQRKNKKATADDQPETRKERPFHPNDYGKPGPMVRSIRLPESCGLGVGVRGGIAKLGDSQRTEVYWTASSYFFRPRYALSDELVYGIPEVPSGSKLVFTLIKNDYLGVVLSSGEKREGYFVMYEGDGRVQIRRHDLPRIVDYVEQQSGQPTESDEDSEEEIEPISGKKKKKVILAWRDPVAKIANITKFK

SEQ ID NO: 5826 - protein, 1529 aa, unidentified
  REGION 1..1529: note = Description of Unknown:uncultivated organism
  REGION 1..1529: note = MG50-3 effector
MTSKQENLGALTFGLDIGIASVGWAVLNEKRIVDLGVRAFDAAEDPEDGTPYNQKRRSGRVARNRLHTRAWRLKRLRRLLRDAGLISSASFQNINQKSRQKGADDTSPWTLRSKALTEKLNPDDWARVIYHLVKHRGFGVLSQSELEIDPDAPENNDKKAGLTDGLKHNSALLRKHKESLKTLGNIAVQLPNLEPDSEDGKSFKLSIRNKDKSYRHAFLRDDLRNELETLFIEQERLGNPFINISLPEHKDRLKLVNIGGEKKEVPLTFKDQVFALFDMQKPPISTEQMNGLIGDCEFERGEKRAPRNSFSNERSTWLQKLNSIKIKRYGKEEFLNKEKEEWLAVINLPYEKEKVTYSDIRDALCQKTGFSRDWREASFNMLSYRPKIKADAGWINVIDGDKVTPLNKYNNFGDKAELKEAKKKLKDTLLNSTLTYGELRTLFNVPEQCKFQYAHKEQELIQKELEATHAIPFSKDDSEYILKDGITYKINLQKSNKSNKLSKKSYALLAELKKSKPDATLSNLRVIIEQAESINEPWLFEFNQTVRIEISPAKEADTRVPIEYENIQSVEDSTCIELKGWHKLRKALAQQCPDFWQSLAVAYQQPTSIEGKETASELDEVVQVLAIYQTDFERKRELVFLGIKEEVISELLKINLKDFRNLSIKALRNILPFLEEGDTFDKACGKAHYNHSQRPAQQRKTTLDPFETYQFERWRSRNDGGKARMTKEETRYKDLNNPTVARALNQARRVLNALVEKYGSPAYINVELARDLSRSKRLRDKVKKEQDSRREDNEDADKVLKEIFKDTFGINDPTGEQLLKYKLYKEQECQCAYTYPPLPKGLDLKEVIGDKNYAQIDHIWPRSKTFDNSQNNRVLVLAGANQNKGDNIPWDFFGKKDAAHWQYFQAWVNSCKGMSKEKQDRLLAKELDADEFAARNLVDTRYVTKLFARILRERLLFAGGATEDFAEIGNDESGKDKLEKFYRSRVRTPQGGAISFLRRCWGLQKVREESDLHHALDACVIAATSHSLIKQVNDFNRREEQFPYRYKKNDDGNFVDTKTGEVLTKDEALEAGVFFPKPWKHFREEVLARLSSDGRTYQTKKGERRIYDFANYEKDEISQVQPVLVSRAVKKKRNVELHDANPMALRYYPINLMDLTLDIIDEKRLPPNLPEDRYSLIQAIRNQLLSSDGDAAIAFPNGFLTKNAKGKDKIIHTIPLPLVSLPDDFLGKVKQQLSASGTNENLKDTAKKNIPLNKLSLKVLSEKELGAAFYHRNQRMIDALKSQLSKYDDNAEKAFPEPIFYPFGKDHPFIKSMRLPAPRSSGIFVRGGIANLGEALYTEIYKYEGSYWFRARYQVAKEKTFGLPVMPVGAEFICNLTKNEYIRIKHPNLVHCYREVSRYTDSLGNILINVEAIFDNGIFEGYWNNFEPSAKRPVLYLQDKKSFFLLEDGKVLDKKILILIAKPKAKQASKEQVELEYLEFTEGQPQEKPLKFDLKVGRDAVIQRGIKDAAFIEKIKVSVLGSLQKNLKE

SEQ ID NO: 5827 - protein, 1010 aa, unidentified
  REGION 1..1010: note = Description of Unknown:uncultivated organism
  REGION 1..1010: note = MG51-1 effector
METELVLGLDLGTNSAGWALIEHSVDADGLAKPTRLVDAGVRIFPEGIEAKSSESRNVARRAARGMRRQHDRRNRRRDALRHRLQRAGLLPREKTELAAVLSANPYALRARGLDEKLEPFELGRALYHLGNRRGFKSNRKTERKTNKKDKDTVQTAITDLQKKIEDAKARTLGEYLSRIDPFKERTRCRYTSRAMYEHEFDALWDAQRPNHPAILTDDLRRQIHETIFNQRPLKVQKNLVGKCELEPTRKRAPKGLWYAQQFRLLQDVSHLEVLDIKTGEIRKLNDGERKELIAELQKKQTMTFDQIRKTLGMLDGQKFNFETANHRDKLKGNSTEARLRKALAKSYDQLTAQTRDEIVRDLLYLDDADVIRSHAISRWKLNEEAAEKLAGIDLESGYLHLSERALRKLIPHLEQGLSYMEAVVAAGYERPDQRKIEVRKELTREDMPDLRNPIVTVAMNQTRRLVNAIVREHGKPARIRVEMARDLKVSLKKRSEILSENKKNRLENETTDKILEQDFGISNPSRDDRVRYRLWKEAGYACPYSGQTIPKQSLFSPDWEVDHILPLPLSGDDSYLNKVLCATAANRDKGDRTPWQAWHGEETRWDEIVHRIKVLPWPKRKRFEVKEIDTDVFIARQLNDTRYIAREARSYLETLTGKNGVQVGKGGVTAALRRRWGLNGILSDSGEKTRADHRHHAIDAVVIALTTVGVVKRMSRLSALGRRPEDAGFPPPWEHFRDDVKRRVETMLVSHQAQRGLRGPLHEETNYGILGLKDEKGNELFAVRKSLAAMTQSELERVADNNVREIVKAHLRAHGADPEARNAEKTEQWKKAMTPPNYPTLPNGNGAPVPIKKVRLHKPSGGMIRMKNRDGVEYRAVESGSNHHIVIFEHTAEGKKKGGWDGEVVSMFEAAQRIRRHEPIIRRDLGEGKKFVMSLSINEIVKVTENGESAYWRVQKIDAGNMRVTFRPQNDARKSEDKSFEKTIGVGPLKKLAPAKVTIDPVGREHPAHD

SEQ ID NO: 5828 - protein, 1016 aa, unidentified
  REGION 1..1016: note = Description of Unknown:uncultivated organism
  REGION 1..1016: note = MG51-2 effector
MANVIGLDLGTNSIGWSILETSDERGNHFTGIVASGVRIFQEGVDRTTTGAELSKNAARRTARGTRKLHKRRNQRREALKRLLVENRMLPSGETEWHELMQKNPYELRALGVEKKISLFELGRALYHINQRRGFKSNRKTGESDGKVASALVELEEKIQDSGFKTLGQYLNLLNTREQRIRGRYTKRSMYEQEFDYLWKQQAGHHRDELNDDLKNSIYYAIFYQRPLKNQKNLVGLCEFEKRQVVNAQGEKVWTGKKRSPKGTWYAQQFRLLQEINNLKVIDGTDEWQLADDLDLRDKLVAAMQKKKTMAYAAIRKLLFGKSDQPWEHIRFNLEEGGRDKLKGNDTEASLRAVLKKKYDSLSVEQRDSLIHDLLFIEDEDVLLRHYRGLGDSLGLTNEQVEKLSKIKLQDGYLHVSEKAIKKMLPHLEQGLKYSDAVEAAGYLRKDQQDESIIPQLGEPPQLRNPIVQKALYEVRKVVNAIVREYGKPDFIRVEMGRDLKQSAAQRRESSIQNARNRKRNEEIRNHLQKEYGIANPSRDDVIKFRLWEECHHQCPYTGQTISAEMLFSPEVEIEHILPYSRTLDDSYTNKTLCMSSENANKNNRTPYEAYHADEERYQIILARVRKFAPPFGYRKWNKFRQKEIDLDTFIERQLNDTRYISREVCKYLEPLVGKYHVQSGRGQMTATLRRLWGLNHILHESGEKTREDHRHHAVDAVVTALSTPKALKAVSAASKYGRLDKLSQEQFPMPWDDFRRDVEASIKSIIVSHRVTRKIHGALHEETAYGELKITDEKGQKLYAVRKPVSALSHKEITQIADEKIRGAISSYILQKGFDPKDKSDVAKALKEADKNPPKMRSGQPIRRVRLHKPFTKMLLLKNRQGKTYRAMQEGSNHHIVIYEYEDKKGRSKRGGHVVSMFEAAQRARRGEPIIQRKLVDGQRFVMSLSINELVQVPTGENEFEVYRVQKMNSDLTICLRSHTSAIITDKATRRFVKPNTLNGRKVVIDPIGRVYPAND

SEQ ID NO: 5829 - protein, 1025 aa, unidentified
  REGION 1..1025: note = Description of Unknown:uncultivated organism
  REGION 1..1025: note = MG51-3 effector
MTKILGLDLGTNSIGWALLEASDQRGNDFTGIIKSGVRIFQEGVDRTATGAELSKNATRRTARGARKLHKRRNQRREALKKLLIEHALLPTNEQKWQKVMAVNPYKARATLLNTQQKHVNNADKSILFALGRALYHINQRRGFKSNRKSGESDGKVATALVELEQKIHEGGFETLGQYLYSLDPREQRIRGRYTKRSMYEYEFEVLWNHLAPFYPDKLTNALKDKIYYTIFYQRPLKNQKFLVGLCEFEKKKTINKQGEEVWTGKKRSPKGTWYAQQFRLLSEVNNLKVIDGNDEWQLAEDLDLRDKLIANLQKKKTMNFSAIRKLLFNDGNNPWEHIRFNLEEGGRDKLQGNEVEASLRTILKKKHDDLSVEQRDSLVHDLLFIEDESVLLRHCQQLGKALDLSDEQIEKLSKIKLQDGYGHLSEKAMKKLLPYLEQGLKYSDAVEAAGYLRKDQQDDTMIPQLGEPPQLRNPIVQKALYEVRKVVNAIVREYGKPDFIRVEMARDLKQSSKQRKEVSFQNAKNRRRNEEIKKRLQDEYGIHNPSRDDIIKFRLWEECHHQCPYTGKTISAAMLFSSEVEIEHILPYSRTLDDSYINKTLCMSEENKIKGNQTPYEAYHGDNERYQTMLARVRKFAPPFGYKKWNKFRQKEIDLDSFIERQLNDTRYISREVSKYLQQLVGKYGVQSGRGQMTATLRKLWGLNGILHESGEKTREDHRHHAVDAVVTALSTPKALKAVSAASKYGRLDKLSQEQFPMPWDGFRHDIEQSIQSIIVSHRVMRKIRGALHEETAYGALKFTDEKGQKMYAVRKPVTALSHKEITQIADDKIRGAITSYILQKGFDPKVKSDVEKALKEVDKEPPTMQSGQPIKRVRLHKPFSKMRMLKNKKGEPYRAMQEGSNHHIVIYEYQDKRGKTKRGGHVVSMFEAAQRARRGEPIIQRKLEDGQKFIMSLSINELVQVPKGEDEFDVYRVQQISLDTKMMLRLDKAASLGNNDERLIKMPNTLKGQKIVIDPLGKIYPAND

SEQ ID NO: 5830 - protein, 773 aa, unidentified
  REGION 1..773: note = Description of Unknown:uncultivated organism
  REGION 1..773: note = MG51-4 effector
YKRNDRLRNTHSHEKIEDAKARTLGEYLSRIDPFKERTRCRYTSRAMYEHEFDALWDAQRPNHPAILTDDLRRQIHETIFNQRPLKVQKNLVGKCELEPTRKRAPKGLWYAQQFRLLQDVSHLEVLDIKTGEIRKLNDGERKELIAELQKKQTMTFDQIRKTLGMLDGQKFNFETANHRDKLKGNSTEARLRKALAKSYDQLTAQTRDEIVRDLLYLDDADVIRSHAISRWKLNEEAAEKLAGIDLESGYLHLSERALRKLIPHLEQGLSYMEAVVAAGYERPDQRKIEVRKELTREDMPDLRNPIVTVAMNQTRRLVNAIVREHGKPARIRVEMARDLKVSLKKRSEILSENKKNRLETETTDKILEQDFGISNPSRDDRVRYRLWKEAGYACPYSGQTIPKQSLFSPDWEVDHILPLPLSGDDSYLNKVLCATAANRDKGDRTPWQAWHGEETRWDEIVHRIKVLPWPKRKRFEVKEIDTDVFIARQLNDTRYIAREARSYLETLTGKNGVQVGKGGVTAALRRRWGLNGILSDSGEKTRADHRHHAIDAVVIALTTVGVVKRMSRLSALGRRPEDAGFPPPWEHFRDDVKRRVETMLVSHQAQRGLRGPLHEETNYGILGLKDEKGNELFAVRKSLAAMTQSELERVADNNVREIVKAHLRAHGADPEARNAEKTEQWKKAMTPPNYPTLPNGNGAPVPIKKVRLHKPSGGMIRMKNRDGVEYRAVESGSNHHIVIFEHTAEGKKKGGWDGEVVSMFEAGKAIPPTAHII

SEQ ID NO: 5831 - protein, 1070 aa, unidentified
  REGION 1..1070: note = Description of Unknown:uncultivated organism
  REGION 1..1070: note = MG52-1 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLEALDPFVLRQKAVNEKISLPELGRALFHLNQRRGFKSNRKSDGKESESGKIKLAVQALETQLAEQGCRTYGEYLCRRHEKRISTKVRPMADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRPGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRELEKRQKENQKDNEKIAEELERAGQPNTYQNRMMYKIWKRLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADVAIRSKLLDLLQNVEDKKQRQQLTEEFMAETGIRRVRCHIEKSDSVMIPVRDNGGQIYKYYESGNNSRADIYCATKGKDAGKWKCEIISTYSANQKDFVPEWRRRDPHAKLIMKLHINDMVAYDELNKGTGQTERVIARVKKMTSGLVFLRGHLIAKEEGDKLSWGASANQMQEKNLRKVYVDAMGKVKDPMFKNERKVS

SEQ ID NO: 5832 - protein, 1070 aa, unidentified
  REGION 1..1070: note = Description of Unknown:uncultivated organism
  REGION 1..1070: note = MG52-2 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLEALDPFVLRQEAVNEKISLPELGRALFHLNQRRGFKSNRKSDDKESESGKIKLAVQALETQLAEQGCRTYGEYLCRRHEKRISTKVRPTADSKGYEFYPTREMAEHEFDLIMSRQQQYHPELTSEITEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPDRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADVAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSKKFSASQMQEKNLRKVYVDAMGKVKDPMFKNERKVS

SEQ ID NO: 5833 - protein, 1070 aa, unidentified
  REGION 1..1070: note = Description of Unknown:uncultivated organism
  REGION 1..1070: note = MG52-3 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLEALDPFVLRQKAVNEKISLPELGRALFHLNQRRGFKSNRKSDGKESESGKIKLAVQALETQLAEQGCRTYGEYLCRRHEKRISTKVRPTADSKGYEFYPPREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFETEHLIPFSRSFDDSINNKVISSRDANRFKAERTPYEAFGNSPGNYKWEEIVARSENLPREMQWRFSADAMEKFAEEDGCLARMLTDTQYFARCALQYLEAICENQSKDRKMAWGIPGQLTAMLRDKWGLNSLINPTDRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVFLRGHLIAKEEGDKLSWGASANQMQEKNLRKVYVDAMGKVKDPMFKNERKIS

SEQ ID NO: 5834 - protein, 1070 aa, unidentified
  REGION 1..1070: note = Description of Unknown:uncultivated organism
  REGION 1..1070: note = MG52-4 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLEALDPFVLRQKAVNEKISLPELGRALFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGNSPGNYKWEEIVARSENLPREMQWRFSADAMEKFAEEDGCLARMLTDTQYFARCALQYLEAICENQSKDRKMAWGIPGQLTAMLRDKWGLNSLINPTDRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSKKFSASQMQEKNLRKVYVDAMGKVKDPMFKNERKVS

SEQ ID NO: 5835 - protein, 1070 aa, unidentified
  REGION 1..1070: note = Description of Unknown:uncultivated organism
  REGION 1..1070: note = MG52-5 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLEALDPFVLRQKAVNEKISLPELGRVLFHLNQRRGFKSNRKSDGKESESGKIKLAVQALETQLAEQGCRTYGEYLCRRHEKRISTKVRPMADSKGYEFYPTREMAEHEFDLIMSRQQQYHPELTSEITESLRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPDRQVELLELLHNAEDDGKLKQDLIDLFGLNEEQAENVAKLNLPEGYASLSLKAIKNILLYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGNSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADVAIRSKLLDLLQNVEDKKQRQQLTEEFMAETGIRRVRCHIEKSDSVMIPVRDNGGQIYKYYESGNNSRADIYCATKGKDAGKWKCEIISTYSANQKDFVPEWRRRDPHAKLIMKLHINDMVAYDELNKGTGQTERVIARVKKMTSGLVFLRGHLIAKEEGDKLSWGASANQMQEKNLRKVYVDAMGKVKDPMFKNERKVS

SEQ ID NO: 5836 - protein, 1070 aa, unidentified
  REGION 1..1070: note = Description of Unknown:uncultivated organism
  REGION 1..1070: note = MG52-6 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLEALDPFVLRQKAVNEKISLPELGRVLFHLNQRRGFKSNRKSDGKESESGKIKLAVQALETQLAEQGCRTYGEYLCRRHEKRISTKVRPMADSKGYEFYPTREMAEHEFDLIMSRQQQYHPELTSEITESLRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPDRQVELLELLHNAEDDGKLKQDLIDLFGLNEEQAENVAKLNLPEGYASLSLKAIKNILLYLEQGKVYSEACTLAGYNHTDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGNSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADVAIRSKLLDLLQNVEDKKQRQQLTEEFMAETGIRRVRCHIEKSDSVMIPVRDNGGQIYKYYESGNNSRADIYCATKGKDAGKWKCEIISTYSANQKDFVPEWRRRDPHAKLIMKLHINDMVAYDELNKGTGQTERVIARVKKMTSGLVFLRGHLIAKEEGDKLSWGASANQMQEKNLRKVYVDAMGKVKDPMFKNERKVS

SEQ ID NO: 5837 - protein, 1070 aa, unidentified
  REGION 1..1070: note = Description of Unknown:uncultivated organism
  REGION 1..1070: note = MG52-7 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLEALDPFVLRQKAVNEKISLPELGRVLFHLNQRRGFKSNRKSDGKESESGKIKLAVQALETQLAEQGCRTYGEYLCRRHEKRISTKVRPMADSKGYEFYPTREMAEHEFDLIMSRQQQYHPELTSEITESLRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDISLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGNSPGNYKWEEIVARSENLPREMQWRFSADAMEKFAEEDGCLARMLTDTQYFARCALQYLEAICENQSKDRKMAWGIPGQLTAMLRDKWGLNSLINPTDRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSKKFSASQMQEKNLRKVYVDAMGKVKDPMFKNERKVS

SEQ ID NO: 5838 - protein, 1070 aa, unidentified
  REGION 1..1070: note = Description of Unknown:uncultivated organism
  REGION 1..1070: note = MG52-8 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLETLDPFVLRQKAVNEKISLPELGRVLFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKISPDRQVELLELLHNAEDDGKLKQDLIDQFSLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHLEKSDSVMIPVKDNGGQIYKYYESGNNSRADIYCATKGKDAGKWKCEIISTYSANQKDFVPEWRRRDPHAKLIMKLHINDMVAYEELNKETGQTERVIARVKKMTSGLVFLRGHLIAKEEGDKLSWGASANQMQEKNLRKVYVDAMGKVKDPMFKNERKVS

SEQ ID NO: 5839 - protein, 1070 aa, unidentified
  REGION 1..1070: note = Description of Unknown:uncultivated organism
  REGION 1..1070: note = MG52-9 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLETLDPFVLRQKAVNEKISLPELGRVLFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPTDRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDGVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSWGASANQMQEKNLRKVYVDAMGKVKDPMFKNERKVS

SEQ ID NO: 5840 - protein, 1070 aa, unidentified
  REGION 1..1070: note = Description of Unknown:uncultivated organism
  REGION 1..1070: note = MG52-10 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLETLDPFVLRQKAVNEKISLPELGRVLFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPTDRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSWGASANQMQEKNLRKVYVDAMGKVKDPMFKNERKVS

SEQ ID NO: 5841 - protein, 1070 aa, unidentified
  REGION 1..1070: note = Description of Unknown:uncultivated organism
  REGION 1..1070: note = MG52-11 effector
MFYRLGIDIGETSIGWFILQLDKKLEICDIVDGGVYIFPDGREAKSREPLSVSRRTARGIRRNLDRKNNRKRRLIRLLEETGIWPDGIAEQKKLETLDPFVLRQKAVNEKISLPELGRVLFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAIGENQSKDRKMAWGIPGQLTAMLRDKWGLNSLINPTDRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDGVMIPVKDNGGQIYKYYESGNNSRADIYCATKGKDAGKWKCEIISTYSANQKDFVPEWRRRDPHAKLIMKLHINDMVAYDELNKETGQTERVIARVKKMTKGLVFLRGHLIAKEEGDKLSWGASANQMQEKNLRKVYVDAMGKVKDPMFKNERKVS

SEQ ID NO: 5842 - protein, 1070 aa, unidentified
  REGION 1..1070: note = Description of Unknown:uncultivated organism
  REGION 1..1070: note = MG52-12 effector
MFYRLGIDIGETSIGWFILQLDKKLEICDIVDGGVYIFPDGREAKSREPLSVSRRTARGIRRNLDRKNNRKRRLIRLLEETGIWSDDIAEQKKLEALDPFVLRQKAVNEKISLPELGRALFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKISPDRQVELLELLHNAEDDGKLKQDLIDQFSLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHLEKSDSVMIPVKDNGGQIYKYYESGNNSRADIYCATKGKDAGKWKCEIISTYSANQKDFVPEWRRRDPHAKLIMKLHINDMVAYEELNKETGQTERVIARVKKMTSGLVFLRGHLIAKEEGDKLSWGASANQMQEKNLRKVYVDAMGKVKDPMFKNERKVS

SEQ ID NO: 5843 - protein, 1070 aa, unidentified
  REGION 1..1070: note = Description of Unknown:uncultivated organism
  REGION 1..1070: note = MG52-13 effector
MFYRLGIDIGETSIGWFILQLDKKLEICDIVDGGVYIFPDGREAKSREPLSVSRRTARGIRRNLDRKNNRKRRLIRLLEETGIWSDDIAEQKKLEALDPFVLRQKAVNEKISLPELGRALFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKISPDRQVELLELLHNAEDDGKLKQDLIDQFSLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPTDRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSWGASANQMQEKNLRKVYVDAMGKVKDPMFKNERKVS

SEQ ID NO: 5844 - protein, 1070 aa, unidentified
  REGION 1..1070: note = Description of Unknown:uncultivated organism
  REGION 1..1070: note = MG52-14 effector
MFYRLGIDIGETSIGWFILQLDKKLEICDIVDGGVYIFPDGREAKSREPLSVSRRTARGIRRNLDRKNNRKRRLIRLLEKTGIWPDGIAEQKKLEALDPFVLRQKAVNEKISLPELGRALFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEISLTAEQKKKILLMLQEGTGLNKQGLLLFTKIKSKLNIPTKRKFNLQSDKRTGLQGDWAAWKLSDDNCLGKGWFKMSPDRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAQDGNKKINEIADVAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSKKFSASQMQEKNLRKVYVDAMGKVKDPMLKNERKVS

SEQ ID NO: 5845 - protein, 1045 aa, unidentified
  REGION 1..1045: note = Description of Unknown:uncultivated organism
  REGION 1..1045: note = MG52-15 effector
MKNYRLGIDLGATSLGWSLIELDNNNETVKLEKVGVRIFPDGRDAKSKEPLNVTRRIARGIRRNRDRYLYRKNELIEYLVNNDLMPEDITERKKIEHLDPYYLRAKGLDEKLELFEFGRVIFHLNQRRGFKSNRKLDSQDNESSIMKTAIIELTEKLQETDSRTLGEYLYNLNKDLPIEEMVHSKPRRVKKGDKSYNLFPERTMYLEEFEQLWEKQQKFHPVLTNKTKTNIENIIFYQRPLQPQEKGRCQFEEEEFRCSFAYVTAQKFRIFQELNNLELLDFNKKSHNLTNEQRAIILHVLLMQKTATFKSLRKKLGKEYYNNFTFNLESEKRKDLKGDETSAVMRKDDYFGDKWDELTDIEKDEIVTKILNEENDKEIEATLISWLEKEYFLPEENAQNIANVSLSKKISNLSRKAIRKLLPFLQDGFIYSDACEKAGYKITDEAPEEPKFYQGDLPYYGELFEKDILFGDKVEINKKYPEKYYGKIPNVTVHIALNQLRKFINELSKTYGAPKQIVLELARELKLGKSKVAEIEKIQAKNRKYNENIALELEKINVENNYTNRTKYKLWEELADDPTKRCCPFSGVQIPIHKLFTHEFQIEHILPKSKTFNDRMINKTIAHRKANQDKGERSPFEAFGHDPAGYNYSEILLRAEQLPYAKRRRFFPDAMKHYEDEGEILSRMLTDTQYMSRIARKYMAFVCGKNNVWSINGQLTAMMRSKWGLNDLLSEDSSKNRADHRHHAVDAFVVACTSRSTMQKVARAIGKSRDKFIDEMPPPFAQFKHKEMKRLLDDMIVSFKPDHGNAKKAISEHKTVGQLHKDTAYGLVSKDEEKGKIILSVRKELVSLESVKKIKEIADPRIRATLLQLTEEKTSKEITAILSEFSKETGIKRVKTHIEKAMDTVVRIEDKHGNYKYYELRNNYCADIYCPDKGKKEGKWQVEIIPMFYAHQINFIPNWQKKNPTAKKIMRLYINDTVAYEENGRTEIRRVKKMTIDGRLFFINHIIAKIDKDPNATSVKQMQEKGYRKVGVDILGRVSDPKKAK

SEQ ID NO: 5846 - protein, 1055 aa, unidentified
  REGION 1..1055: note = Description of Unknown:uncultivated organism
  REGION 1..1055: note = MG52-16 effector
MVFLQLDKKLEICDIVDGGVYIFPDGREAKSRDPLSVSRRTARGIRRNLDRKNNRKRRLIRLLEETGIWPDGIAEQKKLEALDPFVLRQKAVNEKISLPELGRALFHLNQRRGFKSNRKSDGKESESGKIKLAVQALETQLAEQGCRTYGEYLCRRHEKRISTKVRPMADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRPGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRELEKRQKENQKDNEKIAEELERAGQPNTYQNRMMYKIWKRLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADVAIRSKLLDLLQNVEDKKQRQQLTEEFMAETGIRRVRCHIEKSDSVMIPVRDNGGQIYKYYESGNNSRADIYCATKGKDAGKWKCEIISTYSANQKDFVPEWRRRDPHAKLIMKLHINDMVAYDELNKGTGQTERVIARVKKMTSGLVFLRGHLIAKEEGDKLSWGASANQMQEKNLRKVYVDAMGKVKDPMFKNERKVS

SEQ ID NO: 5847-5861 - skipped (15 entries)

SEQ ID NO: 5862 - DNA, 109 bp, synthetic construct
  misc_feature 1..109: note = Description of Artificial Sequence: Syntheticpolynucleotide
  misc_feature 1..109: note = MG40-1 sgRNA
  source 1..109: mol_type = other DNA
nnnnnnnnnnnnnnnnnnnnnnnngttatagcttgaaaaagctataataatcgaaaaatttcgagtggggctctgacgaactgttttttggcagtagtcatcccctttt

SEQ ID NO: 5863 - DNA, 121 bp, synthetic construct
  misc_feature 1..121: note = Description of Artificial Sequence: Syntheticpolynucleotide
  misc_feature 1..121: note = MG40-1 sgRNA
  source 1..121: mol_type = other DNA
nnnnnnnnnnnnnnnnnnnnnnnngttatagcttcctttcgaaagaaaggaagctataataatcgaaaaatttcgagtggggctctgacgaactgttttttggcagtagtcatcccctttt

SEQ ID NO: 5864 - DNA, 97 bp, synthetic construct
  misc_feature 1..97: note = Description of Artificial Sequence: Syntheticoligonucleotide
  misc_feature 1..97: note = MG40-2 sgRNA
  source 1..97: mol_type = other DNA
nnnnnnnnnnnnnnnnnnnnnnnngttatagcttgaaaaagctataataatcgagaaatttcgagtggggctctgatgcttggcatcatcccctttt

SEQ ID NO: 5865 - DNA, 109 bp, synthetic construct
  misc_feature 1..109: note = Description of Artificial Sequence: Syntheticpolynucleotide
  misc_feature 1..109: note = MG40-2 sgRNA
  source 1..109: mol_type = other DNA
nnnnnnnnnnnnnnnnnnnnnnnngttatagcttgctttcgaaagaaagcaagctataataatcgagaaatttcgagtggggctctgatgcttggcatcatcccctttt

SEQ ID NO: 5866 - DNA, 124 bp, synthetic construct
  misc_feature 1..124: note = Description of Artificial Sequence: Syntheticpolynucleotide
  misc_feature 1..124: note = MG40-3 sgRNA
  source 1..124: mol_type = other DNA
nnnnnnnnnnnnnnnnnnnnnnnngttataggttgaaaaaccgtttatataataaagaatattttctgtggggttttacgattatgtatcccctgatgccgtccccaaaacggggacggctttt

SEQ ID NO: 5867 - DNA, 136 bp, synthetic construct
  misc_feature 1..136: note = Description of Artificial Sequence: Syntheticpolynucleotide
  misc_feature 1..136: note = MG40-3 sgRNA
  source 1..136: mol_type = other DNA
nnnnnnnnnnnnnnnnnnnnnnnngttataggttgcttctgaaaagaagcaaccgtttatataataaagaatattttctgtggggttttacgattatgtatcccctgatgccgtccccaaaacggggacggctttt

SEQ ID NO: 5868 - DNA, 123 bp, synthetic construct
  misc_feature 1..123: note = Description of Artificial Sequence: Syntheticpolynucleotide
  misc_feature 1..123: note = MG40-4 sgRNA
  source 1..123: mol_type = other DNA
nnnnnnnnnnnnnnnnnnnnnnnngttataggttgaaaaaccgtttatataataaagaatattttctgtggggttttacgattacgtatcccctgcgccgtcccccaacgggggacggctttt

SEQ ID NO: 5869 - DNA, 135 bp, synthetic construct
  misc_feature 1..135: note = Description of Artificial Sequence: Syntheticpolynucleotide
  misc_feature 1..135: note = MG40-4 sgRNA
  source 1..135: mol_type = other DNA
nnnnnnnnnnnnnnnnnnnnnnnngttataggttgcttctgaaaagaagcaaccgtttatataataaagaatattttctgtggggttttacgattacgtatcccctgcgccgtcccccaacgggggacggctttt

SEQ ID NO: 5870 - DNA, 121 bp, synthetic construct
  misc_feature 1..121: note = Description of Artificial Sequence: Syntheticpolynucleotide
  misc_feature 1..121: note = MG40-5 sgRNA
  source 1..121: mol_type = other DNA
nnnnnnnnnnnnnnnnnnnnnnnngttataggttgaaaaaccgtttatataataaagaatattttctgtggggttctacgattatgtatcccctgaaaccgtccccctgcggggacggttt

SEQ ID NO: 5871 - DNA, 133 bp, synthetic construct
  misc_feature 1..133: note = Description of Artificial Sequence: Syntheticpolynucleotide
  misc_feature 1..133: note = MG40-5 sgRNA
  source 1..133: mol_type = other DNA
nnnnnnnnnnnnnnnnnnnnnnnngttataggttgcttctgaaaagaagcaaccgtttatataataaagaatattttctgtggggttctacgattatgtatcccctgaaaccgtccccctgcggggacggttt

SEQ ID NO: 5872 - DNA, 121 bp, synthetic construct
  misc_feature 1..121: note = Description of Artificial Sequence: Syntheticpolynucleotide
  misc_feature 1..121: note = MG40-6 sgRNA
  source 1..121: mol_type = other DNA
nnnnnnnnnnnnnnnnnnnnnnnngttataggttgaaaaaccgtttatataataaagaatattttctgtggggttctacgattatgtatcccctgaagccgtccccctgcggggacggttt

SEQ ID NO: 5873 - DNA, 133 bp, synthetic construct
  misc_feature 1..133: note = Description of Artificial Sequence: Syntheticpolynucleotide
  misc_feature 1..133: note = MG40-6 sgRNA
  source 1..133: mol_type = other DNA
nnnnnnnnnnnnnnnnnnnnnnnngttataggttgcttctgaaaagaagcaaccgtttatataataaagaatattttctgtggggttctacgattatgtatcccctgaagccgtccccctgcggggacggttt

SEQ ID NO: 5874 - DNA, 105 bp, synthetic construct
  misc_feature 1..105: note = Description of Artificial Sequence: Syntheticpolynucleotide
  misc_feature 1..105: note = MG52-1 sgRNA
  source 1..105: mol_type = other DNA
nnnnnnnnnnnnnnnnnnnngttgcggcttgaccagaaatggtctttccgttaacaagatgaaagattcacaaaattaaaaggcagagttccgtctctgcctttt

SEQ ID NO: 5875 - DNA, 119 bp, synthetic construct
  misc_feature 1..119: note = Description of Artificial Sequence: Syntheticpolynucleotide
  misc_feature 1..119: note = MG52-1 sgRNA
  source 1..119: mol_type = other DNA
nnnnnnnnnnnnnnnnnnnngttgcggcttgaccactctttcgaaagaaaaggtggtctttccgttaacaagatgaaagattcacaaaattaaaaggcagagttccgtctctgcctttt

SEQ ID NO: 5876 - DNA, 121 bp, synthetic construct
  misc_feature 1..121: note = Description of Artificial Sequence: Syntheticpolynucleotide
  misc_feature 1..121: note = MG49-1 sgRNA
  source 1..121: mol_type = other DNA
nnnnnnnnnnnnnnnnnnnnnnnngttgtagttccctattgaaaaataggttactgcaataaagcccttgtgaaagcatggtgctgtaacccgaaagtgccgcgcttgtcgcggcgctttt

SEQ ID NO: 5877 - DNA, 138 bp, synthetic construct
  misc_feature 1..138: note = Description of Artificial Sequence: Syntheticpolynucleotide
  misc_feature 1..138: note = MG49-2 sgRNA
  source 1..138: mol_type = other DNA
nnnnnnnnnnnnnnnnnnnnnnnngttatcggtccctctattttgaaaaaggaaataaaggttccgatagtaaggcttcctgaataaggaatgccgcacgaagagtggcgtctctcaggaggcgtcactctttgtttt

SEQ ID NO: 5878 - DNA, 89 bp, synthetic construct
  misc_feature 1..89: note = Description of Artificial Sequence: Syntheticoligonucleotide
  misc_feature 1..89: note = MG47-1 sgRNA
  source 1..89: mol_type = other DNA
nnnnnnnnnnnnnnnnnnnngttttggtagaaatatcagaacaagactttatgtcgaaatcacattttcgtttgaaaatggttaatttt

SEQ ID NO: 5879 - DNA, 101 bp, synthetic construct
  misc_feature 1..101: note = Description of Artificial Sequence: Syntheticpolynucleotide
  misc_feature 1..101: note = MG47-1 sgRNA
  source 1..101: mol_type = other DNA
nnnnnnnnnnnnnnnnnnnngttttggtactctggaaacagaatctatcagaacaagactttatgtcgaaatcacattttcgtttgaaaatggttaatttt

SEQ ID NO: 5880 - DNA, 113 bp, synthetic construct
  misc_feature 1..113: note = Description of Artificial Sequence: Syntheticpolynucleotide
  misc_feature 1..113: note = MG47-2 sgRNA
  source 1..113: mol_type = other DNA
nnnnnnnnnnnnnnnnnnnngttttagtagaaatactaaaataagactttatgtcgagttcacattctgtgaagaatggaaatttaattatttatgccataaatggacctttt

SEQ ID NO: 5881 - DNA, 125 bp, synthetic construct
  misc_feature 1..125: note = Description of Artificial Sequence: Syntheticpolynucleotide
  misc_feature 1..125: note = MG47-2 sgRNA
  source 1..125: mol_type = other DNA
nnnnnnnnnnnnnnnnnnnngttttagtactttggaaacaaatcctactaaaataagactttatgtcgagttcacattctgtgaagaatggaaatttaattatttatgccataaatggacctttt

SEQ ID NO: 5882 - DNA, 124 bp, synthetic construct
  misc_feature 1..124: note = Description of Artificial Sequence: Syntheticpolynucleotide
  misc_feature 1..124: note = MG51-1 sgRNA
  source 1..124: mol_type = other DNA
nnnnnnnnnnnnnnnnnnnngttgtggggaaactcataacaaggagttccgcaaggaattccgcaggcaaccactgtccttcgggacgtggacccaccttggccgcccgcaagggcggcctttt

SEQ ID NO: 5883 - DNA, 149 bp, synthetic construct
  misc_feature 1..149: note = Description of Artificial Sequence: Syntheticpolynucleotide
  misc_feature 1..149: note = MG51-1 sgRNA
  source 1..149: mol_type = other DNA
nnnnnnnnnnnnnnnnnnnngttgtgggttgcggacaggcgaaagcctgcgcagcttctcataacaaggagttccgcaaggaattccgcaggcaaccactgtccttcgggacgtggacccaccttggccgcccgcaagggcggcctttt

SEQ ID NO: 5884 - DNA, 129 bp, synthetic construct
  misc_feature 1..129: note = Description of Artificial Sequence: Syntheticpolynucleotide
  misc_feature 1..129: note = MG50-1 sgRNA
  source 1..129: mol_type = other DNA
nnnnnnnnnnnnnnnnnnnngttgtagcgaaagctacaataaggccgtcattcatttgatgtgccgtggggtcactgtccggtcgcaagaccggacatcccctaaaccaccctcactccccatccattt

SEQ ID NO: 5885 - DNA, 147 bp, synthetic construct
  misc_feature 1..147: note = Description of Artificial Sequence: Syntheticpolynucleotide
  misc_feature 1..147: note = MG50-1 sgRNA
  source 1..147: mol_type = other DNA
nnnnnnnnnnnnnnnnnnnngttgtagctccctctctgaaaagagccgttgctacaataaggccgtcattcatttgatgtgccgtggggtcactgtccggtcgcaagaccggacatcccctaaaccaccctcactccccatccattt

SEQ ID NO: 5886 - DNA, 134 bp, unidentified
  misc_feature 1..134: note = Description of Unknown:uncultivated organism
  misc_feature 1..134: note = MG48-1 tracr RNA
  source 1..134: mol_type = other DNA
actttcgcaagaaagattgtagaaatcaaagaacggtgtctggggttcgccccgttgcgtcgcaagacgcatatccgttaacaaggattttaatccaccaaataagagaccgaacttttgttcggtctcgtttt

SEQ ID NO: 5887 - DNA, 36 bp, unidentified
  misc_feature 1..36: note = Description of Unknown:uncultivated organism
  misc_feature 1..36: note = MG48-1 CRISPR repeat
  source 1..36: mol_type = other DNA
gttgcggattgacactggttctttgatttctacaat

SEQ ID NO: 5888 - DNA, 140 bp, synthetic construct
  misc_feature 1..140: note = Description of Artificial Sequence: Syntheticpolynucleotide
  misc_feature 1..140: note = MG48-1 putative sgRNA
  source 1..140: mol_type = other DNA
nnnnnnnnnnnnnnnnnnnnnnnngttgcggattgacagaaatgtctggggttcgccccgttgcgtcgcaagacgcatatccgttaacaaggattttaatccaccaaataagagaccgaacttttgttcggtctcgtttt

SEQ ID NO: 5889 - DNA, 167 bp, synthetic construct
  misc_feature 1..167: note = Description of Artificial Sequence: Syntheticpolynucleotide
  misc_feature 1..167: note = MG48-1 putative sgRNA
  source 1..167: mol_type = other DNA
nnnnnnnnnnnnnnnnnnnnnnnngttgcggattgacactggttctttgattgaaaaatcaaagaacggtgtctggggttcgccccgttgcgtcgcaagacgcatatccgttaacaaggattttaatccaccaaataagagaccgaacttttgttcggtctcgtttt

SEQ ID NO: 5890 - DNA, 135 bp, unidentified
  misc_feature 1..135: note = Description of Unknown:uncultivated organism
  misc_feature 1..135: note = MG48-2 tracr RNA
  source 1..135: mol_type = other DNA
gctttcgaaagaaagattgtagaaatcaaagaatggagtctggggcgcaagccctgttgcgctttcgggcgcatatccgttaacaaggactttcagtccgccaaataagggccgaacattcgttcggcccgtttt

SEQ ID NO: 5891 - DNA, 36 bp, unidentified
  misc_feature 1..36: note = Description of Unknown:uncultivated organism
  misc_feature 1..36: note = MG48-2 CRISPR repeat
  source 1..36: mol_type = other DNA
gttgcggattgactactgttctttgatttctacaat

SEQ ID NO: 5892 - DNA, 152 bp, synthetic construct
  misc_feature 1..152: note = Description of Artificial Sequence: Syntheticpolynucleotide
  misc_feature 1..152: note = MG48-2 putative sgRNA
  source 1..152: mol_type = other DNA
nnnnnnnnnnnnnnnnnnnnnnnngttgcggattgactactgttgaaaaatggagtctggggcgcaagccctgttgcgctttcgggcgcatatccgttaacaaggactttcagtccgccaaataagggccgaacattcgttcggcccgtttt

SEQ ID NO: 5893 - DNA, 122 bp, unidentified
  misc_feature 1..122: note = Description of Unknown:uncultivated organism
  misc_feature 1..122: note = MG48-3 tracr RNA
  source 1..122: mol_type = other DNA
aatcaaagaacgggctcgaaaatggcaaatcattttcggactttaattaaatttaaagttgtccgttaacaaggaatttatttccaccaaataagggcgatgcttttgcatcgcctcttttt

SEQ ID NO: 5894 - DNA, 36 bp, unidentified
  misc_feature 1..36: note = Description of Unknown:uncultivated organism
  misc_feature 1..36: note = MG48-3 CRISPR repeat
  source 1..36: mol_type = other DNA
gttgcggattgacttctgttctttgatttctacatt

SEQ ID NO: 5895 - DNA, 174 bp, synthetic construct
  misc_feature 1..174: note = Description of Artificial Sequence: Syntheticpolynucleotide
  misc_feature 1..174: note = MG48-3 putative sgRNA
  source 1..174: mol_type = other DNA
nnnnnnnnnnnnnnnnnnnnnnnngttgcggattgacttctgttctttgagaaatcaaagaacgggctcgaaaatggcaaatcattttcggactttaattaaatttaaagttgtccgttaacaaggaatttatttccaccaaataagggcgatgcttttgcatcgcctcttttt

SEQ ID NO: 5896 - DNA, 164 bp, synthetic construct
  misc_feature 1..164: note = Description of Artificial Sequence: Syntheticpolynucleotide
  misc_feature 1..164: note = MG48-3 putative sgRNA
  source 1..164: mol_type = other DNA
nnnnnnnnnnnnnnnnnnnnnnnngttgcggattgacttctgttcgaaagaacgggctcgaaaatggcaaatcattttcggactttaattaaatttaaagttgtccgttaacaaggaatttatttccaccaaataagggcgatgcttttgcatcgcctcttttt

SEQ ID NO: 5897 - DNA, 22 bp, synthetic construct
  misc_feature 1..22: note = Description of Artificial Sequence: Syntheticoligonucleotide
  misc_feature 1..22: note = MG21 Target 1 in HEK293T cells
  source 1..22: mol_type = other DNA
tccctctttagccagagccggg

SEQ ID NO: 5898 - DNA, 22 bp, synthetic construct
  misc_feature 1..22: note = Description of Artificial Sequence: Syntheticoligonucleotide
  misc_feature 1..22: note = MG21 Target 2 in HEK293T cells
  source 1..22: mol_type = other DNA
ccaaagcccattccctctttag

SEQ ID NO: 5899 - DNA, 22 bp, synthetic construct
  misc_feature 1..22: note = Description of Artificial Sequence: Syntheticoligonucleotide
  misc_feature 1..22: note = MG21 Target 3 in HEK293T cells
  source 1..22: mol_type = other DNA
acggcagtcactagggggcgct

SEQ ID NO: 5900 - DNA, 22 bp, synthetic construct
  misc_feature 1..22: note = Description of Artificial Sequence: Syntheticoligonucleotide
  misc_feature 1..22: note = MG21 Target 4 in HEK293T cells
  source 1..22: mol_type = other DNA
gggggcgctcggccaccacagg

SEQ ID NO: 5901 - DNA, 22 bp, synthetic construct
  misc_feature 1..22: note = Description of Artificial Sequence: Syntheticoligonucleotide
  misc_feature 1..22: note = MG21 Target 5 in HEK293T cells
  source 1..22: mol_type = other DNA
acaactgtgttcactagcaacc

SEQ ID NO: 5902 - DNA, 22 bp, synthetic construct
  misc_feature 1..22: note = Description of Artificial Sequence: Syntheticoligonucleotide
  misc_feature 1..22: note = MG21 Target 6 in HEK293T cells
  source 1..22: mol_type = other DNA
gacaccatggtgcatctgactc

SEQ ID NO: 5903 - DNA, 22 bp, synthetic construct
  misc_feature 1..22: note = Description of Artificial Sequence: Syntheticoligonucleotide
  misc_feature 1..22: note = MG21 Target 7 in HEK293T cells
  source 1..22: mol_type = other DNA
tcactagcaacctcaaacagac

SEQ ID NO: 5904 - DNA, 22 bp, synthetic construct
  misc_feature 1..22: note = Description of Artificial Sequence: Syntheticoligonucleotide
  misc_feature 1..22: note = MG21 Target 8 in HEK293T cells
  source 1..22: mol_type = other DNA
gtatcaaggttacaagacaggt

SEQ ID NO: 5905 - DNA, 22 bp, synthetic construct
  misc_feature 1..22: note = Description of Artificial Sequence: Syntheticoligonucleotide
  misc_feature 1..22: note = MG21 Target 9 in HEK293T cells
  source 1..22: mol_type = other DNA
gctggagcagtactctagtaac

SEQ ID NO: 5906 - DNA, 22 bp, synthetic construct
  misc_feature 1..22: note = Description of Artificial Sequence: Syntheticoligonucleotide
  misc_feature 1..22: note = MG21 Target 10 in HEK293T cells
  source 1..22: mol_type = other DNA
aagcagaagacagaccggctgc

SEQ ID NO: 5907-5916 - skipped (10 entries)

SEQ ID NO: 5917 - DNA, 22 bp, synthetic construct
  misc_feature 1..22: note = Description of Artificial Sequence: Syntheticoligonucleotide
  misc_feature 1..22: note = MG22 Target 1 in HEK293T cells
  source 1..22: mol_type = other DNA
gaaatagggggtccaggagcaa

SEQ ID NO: 5918 - DNA, 22 bp, synthetic construct
  misc_feature 1..22: note = Description of Artificial Sequence: Syntheticoligonucleotide
  misc_feature 1..22: note = MG22 Target 2 in HEK293T cells
  source 1..22: mol_type = other DNA
attccctctttagccagagccg

SEQ ID NO: 5919 - DNA, 22 bp, synthetic construct
  misc_feature 1..22: note = Description of Artificial Sequence: Syntheticoligonucleotide
  misc_feature 1..22: note = MG22 Target 3 in HEK293T cells
  source 1..22: mol_type = other DNA
gaagctgggtgaatggagcgag

SEQ ID NO: 5920 - DNA, 22 bp, synthetic construct
  misc_feature 1..22: note = Description of Artificial Sequence: Syntheticoligonucleotide
  misc_feature 1..22: note = MG22 Target 4 in HEK293T cells
  source 1..22: mol_type = other DNA
ctgacacaactgtgttcactag

SEQ ID NO: 5921 - DNA, 22 bp, synthetic construct
  misc_feature 1..22: note = Description of Artificial Sequence: Syntheticoligonucleotide
  misc_feature 1..22: note = MG22 Target 6 in HEK293T cells
  source 1..22: mol_type = other DNA
gtatcaaggttacaagacaggt

SEQ ID NO: 5922 - DNA, 22 bp, synthetic construct
  misc_feature 1..22: note = Description of Artificial Sequence: Syntheticoligonucleotide
  misc_feature 1..22: note = MG22 Target 7 in HEK293T cells
  source 1..22: mol_type = other DNA
gccgttactgccctgtggggca

SEQ ID NO: 5923 - DNA, 22 bp, synthetic construct
  misc_feature 1..22: note = Description of Artificial Sequence: Syntheticoligonucleotide
  misc_feature 1..22: note = MG22 Target 8 in HEK293T cells
  source 1..22: mol_type = other DNA
ggcagagggtgcatcacctgga

SEQ ID NO: 5924 - DNA, 22 bp, synthetic construct
  misc_feature 1..22: note = Description of Artificial Sequence: Syntheticoligonucleotide
  misc_feature 1..22: note = MG22 Target 9 in HEK293T cells
  source 1..22: mol_type = other DNA
gaatctgctatttgagcaaggc

SEQ ID NO: 5925 - DNA, 22 bp, synthetic construct
  misc_feature 1..22: note = Description of Artificial Sequence: Syntheticoligonucleotide
  misc_feature 1..22: note = MG22 Target 10 in HEK293T cells
  source 1..22: mol_type = other DNA
actaccaagcatcgggcagagg

SEQ ID NO: 5926-5934 - skipped (9 entries)

SEQ ID NO: 5935 - DNA, 22 bp, synthetic construct
  misc_feature 1..22: note = Description of Artificial Sequence: Syntheticoligonucleotide
  misc_feature 1..22: note = MG23 Target 1 in HEK293T cells
  source 1..22: mol_type = other DNA
ggaggtcagaaatagggggtcc

SEQ ID NO: 5936 - DNA, 22 bp, synthetic construct
  misc_feature 1..22: note = Description of Artificial Sequence: Syntheticoligonucleotide
  misc_feature 1..22: note = MG23 Target 2 in HEK293T cells
  source 1..22: mol_type = other DNA
caaagcccattccctctttagc

SEQ ID NO: 5937 - DNA, 22 bp, synthetic construct
  misc_feature 1..22: note = Description of Artificial Sequence: Syntheticoligonucleotide
  misc_feature 1..22: note = MG23 Target 3 in HEK293T cells
  source 1..22: mol_type = other DNA
cggccaccacagggaagctggg

SEQ ID NO: 5938 - DNA, 22 bp, synthetic construct
  misc_feature 1..22: note = Description of Artificial Sequence: Syntheticoligonucleotide
  misc_feature 1..22: note = MG23 Target 5 in HEK293T cells
  source 1..22: mol_type = other DNA
tgtgttcactagcaacctcaaa

SEQ ID NO: 5939 - DNA, 22 bp, synthetic construct
  misc_feature 1..22: note = Description of Artificial Sequence: Syntheticoligonucleotide
  misc_feature 1..22: note = MG23 Target 7 in HEK293T cells
  source 1..22: mol_type = other DNA
ccgttactgccctgtggggcaa

SEQ ID NO: 5940 - DNA, 22 bp, synthetic construct
  misc_feature 1..22: note = Description of Artificial Sequence: Syntheticoligonucleotide
  misc_feature 1..22: note = MG23 Target 8 in HEK293T cells
  source 1..22: mol_type = other DNA
aaggaaactggaacacaaagca

SEQ ID NO: 5941 - DNA, 22 bp, synthetic construct
  misc_feature 1..22: note = Description of Artificial Sequence: Syntheticoligonucleotide
  misc_feature 1..22: note = MG23 Target 9 in HEK293T cells
  source 1..22: mol_type = other DNA
tccagcccgctggccctgtaaa

SEQ ID NO: 5942-5949 - skipped (8 entries)

SEQ ID NO: 5950 - DNA, 22 bp, synthetic construct
  misc_feature 1..22: note = Description of Artificial Sequence: Syntheticoligonucleotide
  misc_feature 1..22: note = MG3-6 TRAC Guide 1
  source 1..22: mol_type = other DNA
ctcaaacaaatgtgtcacaaag

SEQ ID NO: 5951 - DNA, 22 bp, synthetic construct
  misc_feature 1..22: note = Description of Artificial Sequence: Syntheticoligonucleotide
  misc_feature 1..22: note = MG3-6 TRAC Guide 2
  source 1..22: mol_type = other DNA
agagtctctcagctggtacacg

SEQ ID NO: 5952 - DNA, 22 bp, synthetic construct
  misc_feature 1..22: note = Description of Artificial Sequence: Syntheticoligonucleotide
  misc_feature 1..22: note = MG3-6 TRAC Guide 3
  source 1..22: mol_type = other DNA
tctcagctggtacacggcaggg

SEQ ID NO: 5953 - DNA, 22 bp, synthetic construct
  misc_feature 1..22: note = Description of Artificial Sequence: Syntheticoligonucleotide
  misc_feature 1..22: note = MG3-6 TRAC Guide 4
  source 1..22: mol_type = other DNA
ctcagctggtacacggcagggt

SEQ ID NO: 5954 - DNA, 22 bp, synthetic construct
  misc_feature 1..22: note = Description of Artificial Sequence: Syntheticoligonucleotide
  misc_feature 1..22: note = MG3-6 TRAC Guide 5
  source 1..22: mol_type = other DNA
aactttcaaaacctgtcagtga

SEQ ID NO: 5955 - DNA, 22 bp, synthetic construct
  misc_feature 1..22: note = Description of Artificial Sequence: Syntheticoligonucleotide
  misc_feature 1..22: note = MG3-6 TRAC Guide 6
  source 1..22: mol_type = other DNA
cgaatcctcctcctgaaagtgg

SEQ ID NO: 5956 - DNA, 22 bp, synthetic construct
  misc_feature 1..22: note = Description of Artificial Sequence: Syntheticoligonucleotide
  misc_feature 1..22: note = MG3-6 TRAC Guide 7
  source 1..22: mol_type = other DNA
ttaaacccggccactttcagga

SEQ ID NO: 5957 - DNA, 22 bp, synthetic construct
  misc_feature 1..22: note = Description of Artificial Sequence: Syntheticoligonucleotide
  misc_feature 1..22: note = MG3-6 TRAC Guide 8
  source 1..22: mol_type = other DNA
aggattcggaacccaatcactg

SEQ ID NO: 5958 - DNA, 22 bp, synthetic construct
  misc_feature 1..22: note = Description of Artificial Sequence: Syntheticoligonucleotide
  misc_feature 1..22: note = MG3-6 TRAC Guide 9
  source 1..22: mol_type = other DNA
atcactgacaggttttgaaagt

SEQ ID NO: 5959 - DNA, 22 bp, synthetic construct
  misc_feature 1..22: note = Description of Artificial Sequence: Syntheticoligonucleotide
  misc_feature 1..22: note = MG3-8 TRAC Guide 1
  source 1..22: mol_type = other DNA
acagacaaaactgtgctagaca

SEQ ID NO: 5960 - DNA, 22 bp, synthetic construct
  misc_feature 1..22: note = Description of Artificial Sequence: Syntheticoligonucleotide
  misc_feature 1..22: note = MG3-8 TRAC Guide 2
  source 1..22: mol_type = other DNA
gagtctctcagctggtacacgg

SEQ ID NO: 5961 - DNA, 22 bp, synthetic construct
  misc_feature 1..22: note = Description of Artificial Sequence: Syntheticoligonucleotide
  misc_feature 1..22: note = MG3-8 TRAC Guide 3
  source 1..22: mol_type = other DNA
ctcagctggtacacggcagggt

SEQ ID NO: 5962 - DNA, 22 bp, synthetic construct
  misc_feature 1..22: note = Description of Artificial Sequence: Syntheticoligonucleotide
  misc_feature 1..22: note = MG3-8 TRAC Guide 4
  source 1..22: mol_type = other DNA
aactttcaaaacctgtcagtga

SEQ ID NO: 5963 - DNA, 22 bp, synthetic construct
  misc_feature 1..22: note = Description of Artificial Sequence: Syntheticoligonucleotide
  misc_feature 1..22: note = MG3-8 TRAC Guide 5
  source 1..22: mol_type = other DNA
cgaatcctcctcctgaaagtgg

SEQ ID NO: 5964 - DNA, 22 bp, synthetic construct
  misc_feature 1..22: note = Description of Artificial Sequence: Syntheticoligonucleotide
  misc_feature 1..22: note = MG3-8 TRAC Guide 6
  source 1..22: mol_type = other DNA
aggattcggaacccaatcactg

SEQ ID NO: 5965 - DNA, 22 bp, synthetic construct
  misc_feature 1..22: note = Description of Artificial Sequence: Syntheticoligonucleotide
  misc_feature 1..22: note = MG3-8 TRAC Guide 7
  source 1..22: mol_type = other DNA
atcactgacaggttttgaaagt

SEQ ID NO: 5966 - DNA, 20 bp, synthetic construct
  misc_feature 1..20: note = Description of Artificial Sequence: Syntheticoligonucleotide
  misc_feature 1..20: note = MG3-6 TRBC guide 1
  source 1..20: mol_type = other DNA
accagctcagctccacgtgg

SEQ ID NO: 5967 - DNA, 20 bp, synthetic construct
  misc_feature 1..20: note = Description of Artificial Sequence: Syntheticoligonucleotide
  misc_feature 1..20: note = MG3-6 TRBC guide 2
  source 1..20: mol_type = other DNA
acctgcagaagagaaagttt

SEQ ID NO: 5968 - DNA, 20 bp, synthetic construct
  misc_feature 1..20: note = Description of Artificial Sequence: Syntheticoligonucleotide
  misc_feature 1..20: note = MG3-6 TRBC guide 3
  source 1..20: mol_type = other DNA
aggtcaagagaaaggattcc

SEQ ID NO: 5969 - DNA, 20 bp, synthetic construct
  misc_feature 1..20: note = Description of Artificial Sequence: Syntheticoligonucleotide
  misc_feature 1..20: note = MG3-6 TRBC guide 4
  source 1..20: mol_type = other DNA
aggtcctctggaaagggaag

SEQ ID NO: 5970 - DNA, 20 bp, synthetic construct
  misc_feature 1..20: note = Description of Artificial Sequence: Syntheticoligonucleotide
  misc_feature 1..20: note = MG3-6 TRBC guide 5
  source 1..20: mol_type = other DNA
agtatctggagtcattgagg

SEQ ID NO: 5971 - DNA, 20 bp, synthetic construct
  misc_feature 1..20: note = Description of Artificial Sequence: Syntheticoligonucleotide
  misc_feature 1..20: note = MG3-6 TRBC guide 6
  source 1..20: mol_type = other DNA
agtatctggagtcattgagg

SEQ ID NO: 5972 - DNA, 20 bp, synthetic construct
  misc_feature 1..20: note = Description of Artificial Sequence: Syntheticoligonucleotide
  misc_feature 1..20: note = MG3-6 TRBC guide 7
  source 1..20: mol_type = other DNA
atacagggtggccttcccta

SEQ ID NO: 5973 - DNA, 20 bp, synthetic construct
  misc_feature 1..20: note = Description of Artificial Sequence: Syntheticoligonucleotide
  misc_feature 1..20: note = MG3-6 TRBC guide 8
  source 1..20: mol_type = other DNA
atactgcctgagcagccgcc

SEQ ID NO: 5974 - DNA, 20 bp, synthetic construct
  misc_feature 1..20: note = Description of Artificial Sequence: Syntheticoligonucleotide
  misc_feature 1..20: note = MG3-6 TRBC guide 9
  source 1..20: mol_type = other DNA
atactgcctgagcagccgcc

SEQ ID NO: 5975 - DNA, 20 bp, synthetic construct
  misc_feature 1..20: note = Description of Artificial Sequence: Syntheticoligonucleotide
  misc_feature 1..20: note = MG3-6 TRBC guide 10
  source 1..20: mol_type = other DNA
cagatcgtcagcgccgaggc

SEQ ID NO: 5976 - DNA, 20 bp, synthetic construct
  misc_feature 1..20: note = Description of Artificial Sequence: Syntheticoligonucleotide
  misc_feature 1..20: note = MG3-6 TRBC guide 11
  source 1..20: mol_type = other DNA
cagatcgtcagcgccgaggc

SEQ ID NO: 5977 - DNA, 20 bp, synthetic construct
  misc_feature 1..20: note = Description of Artificial Sequence: Syntheticoligonucleotide
  misc_feature 1..20: note = MG3-6 TRBC guide 12
  source 1..20: mol_type = other DNA
caggtcctctggaaagggaa

SEQ ID NO: 5978 - DNA, 20 bp, synthetic construct
  misc_feature 1..20: note = Description of Artificial Sequence: Syntheticoligonucleotide
  misc_feature 1..20: note = MG3-6 TRBC guide 13
  source 1..20: mol_type = other DNA
ccacactggtgtgcctggcc

SEQ ID NO: 5979 - DNA, 20 bp, synthetic construct
  misc_feature 1..20: note = Description of Artificial Sequence: Syntheticoligonucleotide
  misc_feature 1..20: note = MG3-6 TRBC guide 14
  source 1..20: mol_type = other DNA
ccacactggtgtgcctggcc

SEQ ID NO: 5980 - DNA, 20 bp, synthetic construct
  misc_feature 1..20: note = Description of Artificial Sequence: Syntheticoligonucleotide
  misc_feature 1..20: note = MG3-6 TRBC guide 15
  source 1..20: mol_type = other DNA
ccgctgtcaagtccagttct

SEQ ID NO: 5981 - DNA, 20 bp, synthetic construct
  misc_feature 1..20: note = Description of Artificial Sequence: Syntheticoligonucleotide
  misc_feature 1..20: note = MG3-6 TRBC guide 16
  source 1..20: mol_type = other DNA
ccgctgtcaagtccagttct

SEQ ID NO: 5982 - DNA, 20 bp, synthetic construct
  misc_feature 1..20: note = Description of Artificial Sequence: Syntheticoligonucleotide
  misc_feature 1..20: note = MG3-6 TRBC guide 17
  source 1..20: mol_type = other DNA
cctgcagaagagaaagtttt

SEQ ID NO: 5983 - DNA, 20 bp, synthetic construct
  misc_feature 1..20: note = Description of Artificial Sequence: Syntheticoligonucleotide
  misc_feature 1..20: note = MG3-6 TRBC guide 18
  source 1..20: mol_type = other DNA
cggcgctgacgatctgggtg

SEQ ID NO: 5984 - DNA, 20 bp, synthetic construct
  misc_feature 1..20: note = Description of Artificial Sequence: Syntheticoligonucleotide
  misc_feature 1..20: note = MG3-6 TRBC guide 19
  source 1..20: mol_type = other DNA
cggcgctgacgatctgggtg

SEQ ID NO: 5985 - DNA, 20 bp, synthetic construct
  misc_feature 1..20: note = Description of Artificial Sequence: Syntheticoligonucleotide
  misc_feature 1..20: note = MG3-6 TRBC guide 20
  source 1..20: mol_type = other DNA
ctgtggaagagagaacattt

SEQ ID NO: 5986 - DNA, 20 bp, synthetic construct
  misc_feature 1..20: note = Description of Artificial Sequence: Syntheticoligonucleotide
  misc_feature 1..20: note = MG3-6 TRBC guide 21
  source 1..20: mol_type = other DNA
cttccctagcaagatctcat

SEQ ID NO: 5987 - DNA, 20 bp, synthetic construct
  misc_feature 1..20: note = Description of Artificial Sequence: Syntheticoligonucleotide
  misc_feature 1..20: note = MG3-6 TRBC guide 22
  source 1..20: mol_type = other DNA
cttccctagcaggatctcat

SEQ ID NO: 5988 - DNA, 20 bp, synthetic construct
  misc_feature 1..20: note = Description of Artificial Sequence: Syntheticoligonucleotide
  misc_feature 1..20: note = MG3-6 TRBC guide 23
  source 1..20: mol_type = other DNA
cttgacagcggaagtggttg

SEQ ID NO: 5989 - DNA, 20 bp, synthetic construct
  misc_feature 1..20: note = Description of Artificial Sequence: Syntheticoligonucleotide
  misc_feature 1..20: note = MG3-6 TRBC guide 24
  source 1..20: mol_type = other DNA
cttgacagcggaagtggttg

SEQ ID NO: 5990 - DNA, 20 bp, synthetic construct
  misc_feature 1..20: note = Description of Artificial Sequence: Syntheticoligonucleotide
  misc_feature 1..20: note = MG3-6 TRBC guide 25
  source 1..20: mol_type = other DNA
gaatgggaaggaggtgcaca

SEQ ID NO: 5991 - DNA, 20 bp, synthetic construct
  misc_feature 1..20: note = Description of Artificial Sequence: Syntheticoligonucleotide
  misc_feature 1..20: note = MG3-6 TRBC guide 26
  source 1..20: mol_type = other DNA
gaatgggaaggaggtgcaca

SEQ ID NO: 5992 - DNA, 20 bp, synthetic construct
  misc_feature 1..20: note = Description of Artificial Sequence: Syntheticoligonucleotide
  misc_feature 1..20: note = MG3-6 TRBC guide 27
  source 1..20: mol_type = other DNA
gccaacagtgtcctaccagc

SEQ ID NO: 5993 - DNA, 20 bp, synthetic construct
  misc_feature 1..20: note = Description of Artificial Sequence: Syntheticoligonucleotide
  misc_feature 1..20: note = MG3-6 TRBC guide 28
  source 1..20: mol_type = other DNA
gctgatggccatggtaagga

SEQ ID NO: 5994 - DNA, 20 bp, synthetic construct
  misc_feature 1..20: note = Description of Artificial Sequence: Syntheticoligonucleotide
  misc_feature 1..20: note = MG3-6 TRBC guide 29
  source 1..20: mol_type = other DNA
ggcgctgaccagcacagcat

SEQ ID NO: 5995 - DNA, 20 bp, synthetic construct
  misc_feature 1..20: note = Description of Artificial Sequence: Syntheticoligonucleotide
  misc_feature 1..20: note = MG3-6 TRBC guide 30
  source 1..20: mol_type = other DNA
gtcaacagagtcttaccagc

SEQ ID NO: 5996 - DNA, 20 bp, synthetic construct
  misc_feature 1..20: note = Description of Artificial Sequence: Syntheticoligonucleotide
  misc_feature 1..20: note = MG3-6 TRBC guide 31
  source 1..20: mol_type = other DNA
tcggagaatgacgagtggac

SEQ ID NO: 5997 - DNA, 20 bp, synthetic construct
  misc_feature 1..20: note = Description of Artificial Sequence: Syntheticoligonucleotide
  misc_feature 1..20: note = MG3-6 TRBC guide 32
  source 1..20: mol_type = other DNA
tcggagaatgacgagtggac

SEQ ID NO: 5998 - DNA, 20 bp, synthetic construct
  misc_feature 1..20: note = Description of Artificial Sequence: Syntheticoligonucleotide
  misc_feature 1..20: note = MG3-6 TRBC guide 33
  source 1..20: mol_type = other DNA
tctcttccacaggtcaagag

SEQ ID NO: 5999 - DNA, 20 bp, synthetic construct
  misc_feature 1..20: note = Description of Artificial Sequence: Syntheticoligonucleotide
  misc_feature 1..20: note = MG3-6 TRBC guide 34
  source 1..20: mol_type = other DNA
tctcttctgcaggtcaagag

SEQ ID NO: 6000 - DNA, 20 bp, synthetic construct
  misc_feature 1..20: note = Description of Artificial Sequence: Syntheticoligonucleotide
  misc_feature 1..20: note = MG3-6 TRBC guide 35
  source 1..20: mol_type = other DNA
tgagggcgggctgctccttg

SEQ ID NO: 6001 - DNA, 20 bp, synthetic construct
  misc_feature 1..20: note = Description of Artificial Sequence: Syntheticoligonucleotide
  misc_feature 1..20: note = MG3-6 TRBC guide 36
  source 1..20: mol_type = other DNA
tgagggcgggctgctccttg

SEQ ID NO: 6002 - DNA, 20 bp, synthetic construct
  misc_feature 1..20: note = Description of Artificial Sequence: Syntheticoligonucleotide
  misc_feature 1..20: note = MG3-6 TRBC guide 37
  source 1..20: mol_type = other DNA
tgtggaagagagaacatttt

SEQ ID NO: 6003 - DNA, 20 bp, synthetic construct
  misc_feature 1..20: note = Description of Artificial Sequence: Syntheticoligonucleotide
  misc_feature 1..20: note = MG3-6 TRBC guide 38
  source 1..20: mol_type = other DNA
ttgacagcggaagtggttgc

SEQ ID NO: 6004 - DNA, 20 bp, synthetic construct
  misc_feature 1..20: note = Description of Artificial Sequence: Syntheticoligonucleotide
  misc_feature 1..20: note = MG3-6 TRBC guide 39
  source 1..20: mol_type = other DNA
ttgacagcggaagtggttgc

SEQ ID NO: 6005 - DNA, 20 bp, synthetic construct
  misc_feature 1..20: note = Description of Artificial Sequence: Syntheticoligonucleotide
  misc_feature 1..20: note = MG3-8 TRBC Guide 1
  source 1..20: mol_type = other DNA
aatgggaaggaggtgcacag

SEQ ID NO: 6006 - DNA, 20 bp, synthetic construct
  misc_feature 1..20: note = Description of Artificial Sequence: Syntheticoligonucleotide
  misc_feature 1..20: note = MG3-8 TRBC Guide 2
  source 1..20: mol_type = other DNA
aatgggaaggaggtgcacag

SEQ ID NO: 6007 - DNA, 20 bp, synthetic construct
  misc_feature 1..20: note = Description of Artificial Sequence: Syntheticoligonucleotide
  misc_feature 1..20: note = MG3-8 TRBC Guide 3
  source 1..20: mol_type = other DNA
aggtcctctggaaagggaag

SEQ ID NO: 6008 - DNA, 20 bp, synthetic construct
  misc_feature 1..20: note = Description of Artificial Sequence: Syntheticoligonucleotide
  misc_feature 1..20: note = MG3-8 TRBC Guide 4
  source 1..20: mol_type = other DNA
ccaacagtgtcctaccagca

SEQ ID NO: 6009 - DNA, 20 bp, synthetic construct
  misc_feature 1..20: note = Description of Artificial Sequence: Syntheticoligonucleotide
  misc_feature 1..20: note = MG3-8 TRBC Guide 5
  source 1..20: mol_type = other DNA
cctgcagaagagaaagtttt

SEQ ID NO: 6010 - DNA, 20 bp, synthetic construct
  misc_feature 1..20: note = Description of Artificial Sequence: Syntheticoligonucleotide
  misc_feature 1..20: note = MG3-8 TRBC Guide 6
  source 1..20: mol_type = other DNA
cggcgctgacgatctgggtg

SEQ ID NO: 6011 - DNA, 20 bp, synthetic construct
  misc_feature 1..20: note = Description of Artificial Sequence: Syntheticoligonucleotide
  misc_feature 1..20: note = MG3-8 TRBC Guide 7
  source 1..20: mol_type = other DNA
cggcgctgacgatctgggtg

SEQ ID NO: 6012 - DNA, 20 bp, synthetic construct
  misc_feature 1..20: note = Description of Artificial Sequence: Syntheticoligonucleotide
  misc_feature 1..20: note = MG3-8 TRBC Guide 8
  source 1..20: mol_type = other DNA
ctcgggtgggaacaccttgt

SEQ ID NO: 6013 - DNA, 20 bp, synthetic construct
  misc_feature 1..20: note = Description of Artificial Sequence: Syntheticoligonucleotide
  misc_feature 1..20: note = MG3-8 TRBC Guide 9
  source 1..20: mol_type = other DNA
ctgaaaaacgtgttcccacc

SEQ ID NO: 6014 - DNA, 20 bp, synthetic construct
  misc_feature 1..20: note = Description of Artificial Sequence: Syntheticoligonucleotide
  misc_feature 1..20: note = MG3-8 TRBC Guide 10
  source 1..20: mol_type = other DNA
ctgaacaaggtgttcccacc

SEQ ID NO: 6015 - DNA, 20 bp, synthetic construct
  misc_feature 1..20: note = Description of Artificial Sequence: Syntheticoligonucleotide
  misc_feature 1..20: note = MG3-8 TRBC Guide 11
  source 1..20: mol_type = other DNA
cttgggtgggaacacgtttt

SEQ ID NO: 6016 - DNA, 20 bp, synthetic construct
  misc_feature 1..20: note = Description of Artificial Sequence: Syntheticoligonucleotide
  misc_feature 1..20: note = MG3-8 TRBC Guide 12
  source 1..20: mol_type = other DNA
gggctgctccttgaggggct

SEQ ID NO: 6017 - DNA, 20 bp, synthetic construct
  misc_feature 1..20: note = Description of Artificial Sequence: Syntheticoligonucleotide
  misc_feature 1..20: note = MG3-8 TRBC Guide 13
  source 1..20: mol_type = other DNA
gggctgctccttgaggggct

SEQ ID NO: 6018 - DNA, 20 bp, synthetic construct
  misc_feature 1..20: note = Description of Artificial Sequence: Syntheticoligonucleotide
  misc_feature 1..20: note = MG3-8 TRBC Guide 14
  source 1..20: mol_type = other DNA
gtgacaggtttggccctatc

SEQ ID NO: 6019 - DNA, 20 bp, synthetic construct
  misc_feature 1..20: note = Description of Artificial Sequence: Syntheticoligonucleotide
  misc_feature 1..20: note = MG3-8 TRBC Guide 15
  source 1..20: mol_type = other DNA
gtgacgggtttggccctatc

SEQ ID NO: 6020 - DNA, 20 bp, synthetic construct
  misc_feature 1..20: note = Description of Artificial Sequence: Syntheticoligonucleotide
  misc_feature 1..20: note = MG3-8 TRBC Guide 16
  source 1..20: mol_type = other DNA
tactgcctgagcagccgcct

SEQ ID NO: 6021 - DNA, 20 bp, synthetic construct
  misc_feature 1..20: note = Description of Artificial Sequence: Syntheticoligonucleotide
  misc_feature 1..20: note = MG3-8 TRBC Guide 17
  source 1..20: mol_type = other DNA
tactgcctgagcagccgcct

SEQ ID NO: 6022 - DNA, 20 bp, synthetic construct
  misc_feature 1..20: note = Description of Artificial Sequence: Syntheticoligonucleotide
  misc_feature 1..20: note = MG3-8 TRBC Guide 18
  source 1..20: mol_type = other DNA
tcaacagagtcttaccagca

SEQ ID NO: 6023 - DNA, 20 bp, synthetic construct
  misc_feature 1..20: note = Description of Artificial Sequence: Syntheticoligonucleotide
  misc_feature 1..20: note = MG3-8 TRBC Guide 19
  source 1..20: mol_type = other DNA
tgtggaagagagaacatttt

SEQ ID NO: 6024 - DNA, 20 bp, synthetic construct
  misc_feature 1..20: note = Description of Artificial Sequence: Syntheticoligonucleotide
  misc_feature 1..20: note = MG3-8 TRBC Guide 20
  source 1..20: mol_type = other DNA
ttgacagcggaagtggttgc

SEQ ID NO: 6025 - DNA, 20 bp, synthetic construct
  misc_feature 1..20: note = Description of Artificial Sequence: Syntheticoligonucleotide
  misc_feature 1..20: note = MG3-8 TRBC Guide 21
  source 1..20: mol_type = other DNA
ttgacagcggaagtggttgc

SEQ ID NO: 6026 - DNA, 20 bp, synthetic construct
  misc_feature 1..20: note = Description of Artificial Sequence: Syntheticoligonucleotide
  misc_feature 1..20: note = MG3-6 GR GuideMG3-6 GR GuideA1
  source 1..20: mol_type = other DNA
ctcaggagaggggagatgtg

SEQ ID NO: 6027 - DNA, 20 bp, synthetic construct
  misc_feature 1..20: note = Description of Artificial Sequence: Syntheticoligonucleotide
  misc_feature 1..20: note = MG3-6 GR GuideB1
  source 1..20: mol_type = other DNA
ctcctgagcaagcacactgc

SEQ ID NO: 6028 - DNA, 20 bp, synthetic construct
  misc_feature 1..20: note = Description of Artificial Sequence: Syntheticoligonucleotide
  misc_feature 1..20: note = MG3-6 GR GuideC1
  source 1..20: mol_type = other DNA
ctaagaggaggagctactgt

SEQ ID NO: 6029 - DNA, 20 bp, synthetic construct
  misc_feature 1..20: note = Description of Artificial Sequence: Syntheticoligonucleotide
  misc_feature 1..20: note = MG3-6 GR GuideD1
  source 1..20: mol_type = other DNA
ttcacagtagctcctcctct

SEQ ID NO: 6030 - DNA, 20 bp, synthetic construct
  misc_feature 1..20: note = Description of Artificial Sequence: Syntheticoligonucleotide
  misc_feature 1..20: note = MG3-6 GR GuideE1
  source 1..20: mol_type = other DNA
cactggctgtcgcttctcaa

SEQ ID NO: 6031 - DNA, 20 bp, synthetic construct
  misc_feature 1..20: note = Description of Artificial Sequence: Syntheticoligonucleotide
  misc_feature 1..20: note = MG3-6 GR GuideF1
  source 1..20: mol_type = other DNA
tcaatcagactccaagcagc

SEQ ID NO: 6032 - DNA, 20 bp, synthetic construct
  misc_feature 1..20: note = Description of Artificial Sequence: Syntheticoligonucleotide
  misc_feature 1..20: note = MG3-6 GR GuideG1
  source 1..20: mol_type = other DNA
gacttttggttgattttcca

SEQ ID NO: 6033 - DNA, 20 bp, synthetic construct
  misc_feature 1..20: note = Description of Artificial Sequence: Syntheticoligonucleotide
  misc_feature 1..20: note = MG3-6 GR GuideH1
  source 1..20: mol_type = other DNA
cagtaagcaatgcgcagcag

SEQ ID NO: 6034 - DNA, 20 bp, synthetic construct
  misc_feature 1..20: note = Description of Artificial Sequence: Syntheticoligonucleotide
  misc_feature 1..20: note = MG3-6 GR GuideA2
  source 1..20: mol_type = other DNA
caaagcagtttcactctcaa

SEQ ID NO: 6035 - DNA, 20 bp, synthetic construct
  misc_feature 1..20: note = Description of Artificial Sequence: Syntheticoligonucleotide
  misc_feature 1..20: note = MG3-6 GR GuideB2
  source 1..20: mol_type = other DNA
tgagagtgaaactgctttgg

SEQ ID NO: 6036 - DNA, 20 bp, synthetic construct
  misc_feature 1..20: note = Description of Artificial Sequence: Syntheticoligonucleotide
  misc_feature 1..20: note = MG3-6 GR GuideC2
  source 1..20: mol_type = other DNA
aaaagtgatgggaaatgacc

SEQ ID NO: 6037 - DNA, 20 bp, synthetic construct
  misc_feature 1..20: note = Description of Artificial Sequence: Syntheticoligonucleotide
  misc_feature 1..20: note = MG3-6 GR GuideD2
  source 1..20: mol_type = other DNA
atgacctgggattcccacag

SEQ ID NO: 6038 - DNA, 20 bp, synthetic construct
  misc_feature 1..20: note = Description of Artificial Sequence: Syntheticoligonucleotide
  misc_feature 1..20: note = MG3-6 GR GuideE2
  source 1..20: mol_type = other DNA
ttggccctgctgtgggaatc

SEQ ID NO: 6039 - DNA, 20 bp, synthetic construct
  misc_feature 1..20: note = Description of Artificial Sequence: Syntheticoligonucleotide
  misc_feature 1..20: note = MG3-6 GR GuideF2
  source 1..20: mol_type = other DNA
tcagcctttcctcgggggaa

SEQ ID NO: 6040 - DNA, 20 bp, synthetic construct
  misc_feature 1..20: note = Description of Artificial Sequence: Syntheticoligonucleotide
  misc_feature 1..20: note = MG3-6 GR GuideG2
  source 1..20: mol_type = other DNA
taagtctgtttcccccgagg

SEQ ID NO: 6041 - DNA, 20 bp, synthetic construct
  misc_feature 1..20: note = Description of Artificial Sequence: Syntheticoligonucleotide
  misc_feature 1..20: note = MG3-6 GR GuideH2
  source 1..20: mol_type = other DNA
agaaagcattgcaaacctca

SEQ ID NO: 6042 - DNA, 20 bp, synthetic construct
  misc_feature 1..20: note = Description of Artificial Sequence: Syntheticoligonucleotide
  misc_feature 1..20: note = MG3-6 GR GuideA3
  source 1..20: mol_type = other DNA
tggaacactggtcgacctat

SEQ ID NO: 6043 - DNA, 20 bp, synthetic construct
  misc_feature 1..20: note = Description of Artificial Sequence: Syntheticoligonucleotide
  misc_feature 1..20: note = MG3-6 GR GuideB3
  source 1..20: mol_type = other DNA
agcagtggatgctgaactct

SEQ ID NO: 6044 - DNA, 20 bp, synthetic construct
  misc_feature 1..20: note = Description of Artificial Sequence: Syntheticoligonucleotide
  misc_feature 1..20: note = MG3-6 GR GuideC3
  source 1..20: mol_type = other DNA
cttcagaacagcaacatttg

SEQ ID NO: 6045 - DNA, 20 bp, synthetic construct
  misc_feature 1..20: note = Description of Artificial Sequence: Syntheticoligonucleotide
  misc_feature 1..20: note = MG3-6 GR GuideD3
  source 1..20: mol_type = other DNA
gaacagcaacatttgaaggg

SEQ ID NO: 6046 - DNA, 20 bp, synthetic construct
  misc_feature 1..20: note = Description of Artificial Sequence: Syntheticoligonucleotide
  misc_feature 1..20: note = MG3-6 GR GuideE3
  source 1..20: mol_type = other DNA
gcaatgtgaaattgtatacc

SEQ ID NO: 6047 - DNA, 20 bp, synthetic construct
  misc_feature 1..20: note = Description of Artificial Sequence: Syntheticoligonucleotide
  misc_feature 1..20: note = MG3-6 GR GuideF3
  source 1..20: mol_type = other DNA
aaagcacctttgacattttg

SEQ ID NO: 6048 - DNA, 20 bp, synthetic construct
  misc_feature 1..20: note = Description of Artificial Sequence: Syntheticoligonucleotide
  misc_feature 1..20: note = MG3-6 GR GuideG3
  source 1..20: mol_type = other DNA
gcaggatttggagttttctt

SEQ ID NO: 6049 - DNA, 20 bp, synthetic construct
  misc_feature 1..20: note = Description of Artificial Sequence: Syntheticoligonucleotide
  misc_feature 1..20: note = MG3-6 GR GuideH3
  source 1..20: mol_type = other DNA
agagacgaatgagagtcctt

SEQ ID NO: 6050 - DNA, 20 bp, synthetic construct
  misc_feature 1..20: note = Description of Artificial Sequence: Syntheticoligonucleotide
  misc_feature 1..20: note = MG3-6 GR GuideA4
  source 1..20: mol_type = other DNA
tctcattcgtctctttacct

SEQ ID NO: 6051 - DNA, 20 bp, synthetic construct
  misc_feature 1..20: note = Description of Artificial Sequence: Syntheticoligonucleotide
  misc_feature 1..20: note = MG3-6 GR GuideB4
  source 1..20: mol_type = other DNA
tatcaacaggtctgatctcc

SEQ ID NO: 6052 - DNA, 20 bp, synthetic construct
  misc_feature 1..20: note = Description of Artificial Sequence: Syntheticoligonucleotide
  misc_feature 1..20: note = MG3-6 GR GuideC4
  source 1..20: mol_type = other DNA
caaacagttttcatctatca

SEQ ID NO: 6053 - DNA, 20 bp, synthetic construct
  misc_feature 1..20: note = Description of Artificial Sequence: Syntheticoligonucleotide
  misc_feature 1..20: note = MG3-6 GR GuideD4
  source 1..20: mol_type = other DNA
ttttggaaggaaactcgaat

SEQ ID NO: 6054 - DNA, 20 bp, synthetic construct
  misc_feature 1..20: note = Description of Artificial Sequence: Syntheticoligonucleotide
  misc_feature 1..20: note = MG3-6 GR GuideE4
  source 1..20: mol_type = other DNA
aacccaaaattaaggataat

SEQ ID NO: 6055 - DNA, 20 bp, synthetic construct
  misc_feature 1..20: note = Description of Artificial Sequence: Syntheticoligonucleotide
  misc_feature 1..20: note = MG3-6 GR GuideF4
  source 1..20: mol_type = other DNA
gtttagtgtccggtaaaatg

SEQ ID NO: 6056 - DNA, 20 bp, synthetic construct
  misc_feature 1..20: note = Description of Artificial Sequence: Syntheticoligonucleotide
  misc_feature 1..20: note = MG3-6 GR GuideG4
  source 1..20: mol_type = other DNA
gatctccattatccttaatt

SEQ ID NO: 6057 - DNA, 20 bp, synthetic construct
  misc_feature 1..20: note = Description of Artificial Sequence: Syntheticoligonucleotide
  misc_feature 1..20: note = MG3-6 GR GuideH4
  source 1..20: mol_type = other DNA
attactggggcttgacaaaa

SEQ ID NO: 6058 - DNA, 20 bp, synthetic construct
  misc_feature 1..20: note = Description of Artificial Sequence: Syntheticoligonucleotide
  misc_feature 1..20: note = MG3-6 GR GuideA5
  source 1..20: mol_type = other DNA
cccaagtgaaaacagaaaaa

SEQ ID NO: 6059 - DNA, 20 bp, synthetic construct
  misc_feature 1..20: note = Description of Artificial Sequence: Syntheticoligonucleotide
  misc_feature 1..20: note = MG3-6 GR GuideB5
  source 1..20: mol_type = other DNA
ttggggcagtgttacattac

SEQ ID NO: 6060 - DNA, 20 bp, synthetic construct
  misc_feature 1..20: note = Description of Artificial Sequence: Syntheticoligonucleotide
  misc_feature 1..20: note = MG3-6 GR GuideC5
  source 1..20: mol_type = other DNA
cagcatccctttctcaacag

SEQ ID NO: 6061 - DNA, 20 bp, synthetic construct
  misc_feature 1..20: note = Description of Artificial Sequence: Syntheticoligonucleotide
  misc_feature 1..20: note = MG3-6 GR GuideD5
  source 1..20: mol_type = other DNA
ttggtggaatgacattaaaa

SEQ ID NO: 6062 - DNA, 20 bp, synthetic construct
  misc_feature 1..20: note = Description of Artificial Sequence: Syntheticoligonucleotide
  misc_feature 1..20: note = MG3-6 GR GuideE5
  source 1..20: mol_type = other DNA
cgaaaattggaataggtgcc

SEQ ID NO: 6063 - DNA, 20 bp, synthetic construct
  misc_feature 1..20: note = Description of Artificial Sequence: Syntheticoligonucleotide
  misc_feature 1..20: note = MG3-6 GR GuideF5
  source 1..20: mol_type = other DNA
gatgacaacttgacttctct

SEQ ID NO: 6064 - DNA, 20 bp, synthetic construct
  misc_feature 1..20: note = Description of Artificial Sequence: Syntheticoligonucleotide
  misc_feature 1..20: note = MG3-6 GR GuideG5
  source 1..20: mol_type = other DNA
gagaagtcaagttgtcatct

SEQ ID NO: 6065 - DNA, 20 bp, synthetic construct
  misc_feature 1..20: note = Description of Artificial Sequence: Syntheticoligonucleotide
  misc_feature 1..20: note = MG3-6 GR GuideH5
  source 1..20: mol_type = other DNA
tttctaatggctattcaagg

SEQ ID NO: 6066 - DNA, 20 bp, synthetic construct
  misc_feature 1..20: note = Description of Artificial Sequence: Syntheticoligonucleotide
  misc_feature 1..20: note = MG3-6 GR GuideA6
  source 1..20: mol_type = other DNA
ccccttctttagccccagca

SEQ ID NO: 6067 - DNA, 20 bp, synthetic construct
  misc_feature 1..20: note = Description of Artificial Sequence: Syntheticoligonucleotide
  misc_feature 1..20: note = MG3-6 GR GuideB6
  source 1..20: mol_type = other DNA
gcttacatctggtctcatgc

SEQ ID NO: 6068 - DNA, 20 bp, synthetic construct
  misc_feature 1..20: note = Description of Artificial Sequence: Syntheticoligonucleotide
  misc_feature 1..20: note = MG3-6 GR GuideC6
  source 1..20: mol_type = other DNA
cagctcctcaacagcaacaa

SEQ ID NO: 6069 - DNA, 20 bp, synthetic construct
  misc_feature 1..20: note = Description of Artificial Sequence: Syntheticoligonucleotide
  misc_feature 1..20: note = MG3-6 GR GuideD6
  source 1..20: mol_type = other DNA
actttacagcttccacaagt

SEQ ID NO: 6070 - DNA, 20 bp, synthetic construct
  misc_feature 1..20: note = Description of Artificial Sequence: Syntheticoligonucleotide
  misc_feature 1..20: note = MG3-6 GR GuideE6
  source 1..20: mol_type = other DNA
tgccgctatcgaaaatgtct

SEQ ID NO: 6071 - DNA, 20 bp, synthetic construct
  misc_feature 1..20: note = Description of Artificial Sequence: Syntheticoligonucleotide
  misc_feature 1..20: note = MG3-6 GR GuideF6
  source 1..20: mol_type = other DNA
tcagatatttatattacctt

SEQ ID NO: 6072 - DNA, 20 bp, synthetic construct
  misc_feature 1..20: note = Description of Artificial Sequence: Syntheticoligonucleotide
  misc_feature 1..20: note = MG3-6 GR GuideG6
  source 1..20: mol_type = other DNA
aaaaaaataaaaggaattca

SEQ ID NO: 6073 - DNA, 20 bp, synthetic construct
  misc_feature 1..20: note = Description of Artificial Sequence: Syntheticoligonucleotide
  misc_feature 1..20: note = MG3-6 GR GuideH6
  source 1..20: mol_type = other DNA
ggattttcagaggtttcttg

SEQ ID NO: 6074 - DNA, 20 bp, synthetic construct
  misc_feature 1..20: note = Description of Artificial Sequence: Syntheticoligonucleotide
  misc_feature 1..20: note = MG3-6 GR GuideA7
  source 1..20: mol_type = other DNA
gttttgttaccaggattttc

SEQ ID NO: 6075 - DNA, 20 bp, synthetic construct
  misc_feature 1..20: note = Description of Artificial Sequence: Syntheticoligonucleotide
  misc_feature 1..20: note = MG3-6 GR GuideB7
  source 1..20: mol_type = other DNA
aggaactattgttttgttac

SEQ ID NO: 6076 - DNA, 20 bp, synthetic construct
  misc_feature 1..20: note = Description of Artificial Sequence: Syntheticoligonucleotide
  misc_feature 1..20: note = MG3-6 GR GuideC7
  source 1..20: mol_type = other DNA
cctaccctggtgtcactgtt

SEQ ID NO: 6077 - DNA, 20 bp, synthetic construct
  misc_feature 1..20: note = Description of Artificial Sequence: Syntheticoligonucleotide
  misc_feature 1..20: note = MG3-6 GR GuideD7
  source 1..20: mol_type = other DNA
caggatatgatagctctgtt

SEQ ID NO: 6078 - DNA, 20 bp, synthetic construct
  misc_feature 1..20: note = Description of Artificial Sequence: Syntheticoligonucleotide
  misc_feature 1..20: note = MG3-6 GR GuideE7
  source 1..20: mol_type = other DNA
catatcctgcatataacact

SEQ ID NO: 6079 - DNA, 20 bp, synthetic construct
  misc_feature 1..20: note = Description of Artificial Sequence: Syntheticoligonucleotide
  misc_feature 1..20: note = MG3-6 GR GuideF7
  source 1..20: mol_type = other DNA
tctgttccagactcaacttg

SEQ ID NO: 6080 - DNA, 20 bp, synthetic construct
  misc_feature 1..20: note = Description of Artificial Sequence: Syntheticoligonucleotide
  misc_feature 1..20: note = MG3-6 GR GuideG7
  source 1..20: mol_type = other DNA
aacatccaggagtactgcag

SEQ ID NO: 6081 - DNA, 20 bp, synthetic construct
  misc_feature 1..20: note = Description of Artificial Sequence: Syntheticoligonucleotide
  misc_feature 1..20: note = MG3-6 GR GuideH7
  source 1..20: mol_type = other DNA
tatggcatttgctctggggt

SEQ ID NO: 6082 - DNA, 20 bp, synthetic construct
  misc_feature 1..20: note = Description of Artificial Sequence: Syntheticoligonucleotide
  misc_feature 1..20: note = MG3-6 GR GuideA8
  source 1..20: mol_type = other DNA
cagatcaggagcaaaacaca

SEQ ID NO: 6083 - DNA, 20 bp, synthetic construct
  misc_feature 1..20: note = Description of Artificial Sequence: Syntheticoligonucleotide
  misc_feature 1..20: note = MG3-6 GR GuideB8
  source 1..20: mol_type = other DNA
tacaacttactcattaataa

SEQ ID NO: 6084 - DNA, 20 bp, synthetic construct
  misc_feature 1..20: note = Description of Artificial Sequence: Syntheticoligonucleotide
  misc_feature 1..20: note = MG3-6 GR GuideC8
  source 1..20: mol_type = other DNA
gtatgtttcctctgagttac

SEQ ID NO: 6085 - DNA, 20 bp, synthetic construct
  misc_feature 1..20: note = Description of Artificial Sequence: Syntheticoligonucleotide
  misc_feature 1..20: note = MG3-6 GR GuideD8
  source 1..20: mol_type = other DNA
aaaccttactgcttctctct

SEQ ID NO: 6086 - DNA, 20 bp, synthetic construct
  misc_feature 1..20: note = Description of Artificial Sequence: Syntheticoligonucleotide
  misc_feature 1..20: note = MG3-6 GR GuideE8
  source 1..20: mol_type = other DNA
caacctgaagagagaagcag

SEQ ID NO: 6087 - DNA, 20 bp, synthetic construct
  misc_feature 1..20: note = Description of Artificial Sequence: Syntheticoligonucleotide
  misc_feature 1..20: note = MG3-6 GR GuideF8
  source 1..20: mol_type = other DNA
cagaccgtccttaggaacta

SEQ ID NO: 6088 - DNA, 20 bp, synthetic construct
  misc_feature 1..20: note = Description of Artificial Sequence: Syntheticoligonucleotide
  misc_feature 1..20: note = MG3-6 GR GuideG8
  source 1..20: mol_type = other DNA
atcaaatagctcttggctct

SEQ ID NO: 6089 - DNA, 20 bp, synthetic construct
  misc_feature 1..20: note = Description of Artificial Sequence: Syntheticoligonucleotide
  misc_feature 1..20: note = MG3-6 GR GuideH8
  source 1..20: mol_type = other DNA
gcttttcctagctctttgat

SEQ ID NO: 6090 - DNA, 20 bp, synthetic construct
  misc_feature 1..20: note = Description of Artificial Sequence: Syntheticoligonucleotide
  misc_feature 1..20: note = MG3-6 GR GuideA9
  source 1..20: mol_type = other DNA
tttatcaactgacaaaactc

SEQ ID NO: 6091 - DNA, 20 bp, synthetic construct
  misc_feature 1..20: note = Description of Artificial Sequence: Syntheticoligonucleotide
  misc_feature 1..20: note = MG3-8 GR Guide B9
  source 1..20: mol_type = other DNA
ctcctgagcaagcacactgc

SEQ ID NO: 6092 - DNA, 20 bp, synthetic construct
  misc_feature 1..20: note = Description of Artificial Sequence: Syntheticoligonucleotide
  misc_feature 1..20: note = MG3-8 GR Guide C9
  source 1..20: mol_type = other DNA
ctaagaggaggagctactgt

SEQ ID NO: 6093 - DNA, 20 bp, synthetic construct
  misc_feature 1..20: note = Description of Artificial Sequence: Syntheticoligonucleotide
  misc_feature 1..20: note = MG3-8 GR Guide D9
  source 1..20: mol_type = other DNA
ttcacagtagctcctcctct

SEQ ID NO: 6094 - DNA, 20 bp, synthetic construct
  misc_feature 1..20: note = Description of Artificial Sequence: Syntheticoligonucleotide
  misc_feature 1..20: note = MG3-8 GR Guide E9
  source 1..20: mol_type = other DNA
gacttttggttgattttcca

SEQ ID NO: 6095 - DNA, 20 bp, synthetic construct
  misc_feature 1..20: note = Description of Artificial Sequence: Syntheticoligonucleotide
  misc_feature 1..20: note = MG3-8 GR Guide F9
  source 1..20: mol_type = other DNA
atgacctgggattcccacag

SEQ ID NO: 6096 - DNA, 20 bp, synthetic construct
  misc_feature 1..20: note = Description of Artificial Sequence: Syntheticoligonucleotide
  misc_feature 1..20: note = MG3-8 GR Guide G9
  source 1..20: mol_type = other DNA
ttggccctgctgtgggaatc

SEQ ID NO: 6097 - DNA, 20 bp, synthetic construct
  misc_feature 1..20: note = Description of Artificial Sequence: Syntheticoligonucleotide
  misc_feature 1..20: note = MG3-8 GR Guide H9
  source 1..20: mol_type = other DNA
taagtctgtttcccccgagg

SEQ ID NO: 6098 - DNA, 20 bp, synthetic construct
  misc_feature 1..20: note = Description of Artificial Sequence: Syntheticoligonucleotide
  misc_feature 1..20: note = MG3-8 GR Guide A10
  source 1..20: mol_type = other DNA
agaaagcattgcaaacctca

SEQ ID NO: 6099 - DNA, 20 bp, synthetic construct
  misc_feature 1..20: note = Description of Artificial Sequence: Syntheticoligonucleotide
  misc_feature 1..20: note = MG3-8 GR Guide B10
  source 1..20: mol_type = other DNA
tggaacactggtcgacctat

SEQ ID NO: 6100 - DNA, 20 bp, synthetic construct
  misc_feature 1..20: note = Description of Artificial Sequence: Syntheticoligonucleotide
  misc_feature 1..20: note = MG3-8 GR Guide C10
  source 1..20: mol_type = other DNA
agcagtggatgctgaactct

SEQ ID NO: 6101 - DNA, 20 bp, synthetic construct
  misc_feature 1..20: note = Description of Artificial Sequence: Syntheticoligonucleotide
  misc_feature 1..20: note = MG3-8 GR Guide D10
  source 1..20: mol_type = other DNA
cttcagaacagcaacatttg

SEQ ID NO: 6102 - DNA, 20 bp, synthetic construct
  misc_feature 1..20: note = Description of Artificial Sequence: Syntheticoligonucleotide
  misc_feature 1..20: note = MG3-8 GR Guide E10
  source 1..20: mol_type = other DNA
gcaggatttggagttttctt

SEQ ID NO: 6103 - DNA, 20 bp, synthetic construct
  misc_feature 1..20: note = Description of Artificial Sequence: Syntheticoligonucleotide
  misc_feature 1..20: note = MG3-8 GR Guide F10
  source 1..20: mol_type = other DNA
caaacagttttcatctatca

SEQ ID NO: 6104 - DNA, 20 bp, synthetic construct
  misc_feature 1..20: note = Description of Artificial Sequence: Syntheticoligonucleotide
  misc_feature 1..20: note = MG3-8 GR Guide G10
  source 1..20: mol_type = other DNA
gtttagtgtccggtaaaatg

SEQ ID NO: 6105 - DNA, 20 bp, synthetic construct
  misc_feature 1..20: note = Description of Artificial Sequence: Syntheticoligonucleotide
  misc_feature 1..20: note = MG3-8 GR Guide H10
  source 1..20: mol_type = other DNA
gatctccattatccttaatt

SEQ ID NO: 6106 - DNA, 20 bp, synthetic construct
  misc_feature 1..20: note = Description of Artificial Sequence: Syntheticoligonucleotide
  misc_feature 1..20: note = MG3-8 GR Guide A11
  source 1..20: mol_type = other DNA
ttggggcagtgttacattac

SEQ ID NO: 6107 - DNA, 20 bp, synthetic construct
  misc_feature 1..20: note = Description of Artificial Sequence: Syntheticoligonucleotide
  misc_feature 1..20: note = MG3-8 GR Guide B11
  source 1..20: mol_type = other DNA
ttggtggaatgacattaaaa

SEQ ID NO: 6108 - DNA, 20 bp, synthetic construct
  misc_feature 1..20: note = Description of Artificial Sequence: Syntheticoligonucleotide
  misc_feature 1..20: note = MG3-8 GR Guide C11
  source 1..20: mol_type = other DNA
gcttacatctggtctcatgc

SEQ ID NO: 6109 - DNA, 20 bp, synthetic construct
  misc_feature 1..20: note = Description of Artificial Sequence: Syntheticoligonucleotide
  misc_feature 1..20: note = MG3-8 GR Guide D11
  source 1..20: mol_type = other DNA
tgccgctatcgaaaatgtct

SEQ ID NO: 6110 - DNA, 20 bp, synthetic construct
  misc_feature 1..20: note = Description of Artificial Sequence: Syntheticoligonucleotide
  misc_feature 1..20: note = MG3-8 GR Guide E11
  source 1..20: mol_type = other DNA
tcagatatttatattacctt

SEQ ID NO: 6111 - DNA, 20 bp, synthetic construct
  misc_feature 1..20: note = Description of Artificial Sequence: Syntheticoligonucleotide
  misc_feature 1..20: note = MG3-8 GR Guide F11
  source 1..20: mol_type = other DNA
aaaaaaataaaaggaattca

SEQ ID NO: 6112 - DNA, 20 bp, synthetic construct
  misc_feature 1..20: note = Description of Artificial Sequence: Syntheticoligonucleotide
  misc_feature 1..20: note = MG3-8 GR Guide G11
  source 1..20: mol_type = other DNA
gttttgttaccaggattttc

SEQ ID NO: 6113 - DNA, 20 bp, synthetic construct
  misc_feature 1..20: note = Description of Artificial Sequence: Syntheticoligonucleotide
  misc_feature 1..20: note = MG3-8 GR Guide H11
  source 1..20: mol_type = other DNA
cctaccctggtgtcactgtt

SEQ ID NO: 6114 - DNA, 20 bp, synthetic construct
  misc_feature 1..20: note = Description of Artificial Sequence: Syntheticoligonucleotide
  misc_feature 1..20: note = MG3-8 GR Guide A12
  source 1..20: mol_type = other DNA
catatcctgcatataacact

SEQ ID NO: 6115 - DNA, 20 bp, synthetic construct
  misc_feature 1..20: note = Description of Artificial Sequence: Syntheticoligonucleotide
  misc_feature 1..20: note = MG3-8 GR Guide B12
  source 1..20: mol_type = other DNA
aacatccaggagtactgcag

SEQ ID NO: 6116 - DNA, 20 bp, synthetic construct
  misc_feature 1..20: note = Description of Artificial Sequence: Syntheticoligonucleotide
  misc_feature 1..20: note = MG3-8 GR Guide C12
  source 1..20: mol_type = other DNA
cagatcaggagcaaaacaca

SEQ ID NO: 6117 - DNA, 20 bp, synthetic construct
  misc_feature 1..20: note = Description of Artificial Sequence: Syntheticoligonucleotide
  misc_feature 1..20: note = MG3-8 GR Guide D12
  source 1..20: mol_type = other DNA
gtatgtttcctctgagttac

SEQ ID NO: 6118 - DNA, 20 bp, synthetic construct
  misc_feature 1..20: note = Description of Artificial Sequence: Syntheticoligonucleotide
  misc_feature 1..20: note = MG3-8 GR Guide E12
  source 1..20: mol_type = other DNA
aaaccttactgcttctctct

SEQ ID NO: 6119 - DNA, 20 bp, synthetic construct
  misc_feature 1..20: note = Description of Artificial Sequence: Syntheticoligonucleotide
  misc_feature 1..20: note = MG3-8 GR Guide F12
  source 1..20: mol_type = other DNA
caacctgaagagagaagcag

SEQ ID NO: 6120 - DNA, 20 bp, synthetic construct
  misc_feature 1..20: note = Description of Artificial Sequence: Syntheticoligonucleotide
  misc_feature 1..20: note = MG3-8 GR Guide G12
  source 1..20: mol_type = other DNA
cagaccgtccttaggaacta

SEQ ID NO: 6121 - DNA, 20 bp, synthetic construct
  misc_feature 1..20: note = Description of Artificial Sequence: Syntheticoligonucleotide
  misc_feature 1..20: note = MG3-8 GR Guide H12
  source 1..20: mol_type = other DNA
gcttttcctagctctttgat

SEQ ID NO: 6122 - DNA, 22 bp, synthetic construct
  misc_feature 1..22: note = Description of Artificial Sequence: Syntheticoligonucleotide
  misc_feature 1..22: note = MG3-6 AAVS1 GuideA1
  source 1..22: mol_type = other DNA
cctcaccacagccctgccagga

SEQ ID NO: 6123 - DNA, 22 bp, synthetic construct
  misc_feature 1..22: note = Description of Artificial Sequence: Syntheticoligonucleotide
  misc_feature 1..22: note = MG3-6 AAVS1 GuideB1
  source 1..22: mol_type = other DNA
gaagtgtaaggaagctgcagca

SEQ ID NO: 6124 - DNA, 22 bp, synthetic construct
  misc_feature 1..22: note = Description of Artificial Sequence: Syntheticoligonucleotide
  misc_feature 1..22: note = MG3-6 AAVS1 GuideC1
  source 1..22: mol_type = other DNA
cagacggccgcgtcagagcagc

SEQ ID NO: 6125 - DNA, 22 bp, synthetic construct
  misc_feature 1..22: note = Description of Artificial Sequence: Syntheticoligonucleotide
  misc_feature 1..22: note = MG3-6 AAVS1 GuideD1
  source 1..22: mol_type = other DNA
tcagagcagctcaggttctggg

SEQ ID NO: 6126 - DNA, 22 bp, synthetic construct
  misc_feature 1..22: note = Description of Artificial Sequence: Syntheticoligonucleotide
  misc_feature 1..22: note = MG3-6 AAVS1 GuideE1
  source 1..22: mol_type = other DNA
tcaggttctgggagagggtagc

SEQ ID NO: 6127 - DNA, 22 bp, synthetic construct
  misc_feature 1..22: note = Description of Artificial Sequence: Syntheticoligonucleotide
  misc_feature 1..22: note = MG3-6 AAVS1 GuideF1
  source 1..22: mol_type = other DNA
accccctgccaagctctccctc

SEQ ID NO: 6128 - DNA, 22 bp, synthetic construct
  misc_feature 1..22: note = Description of Artificial Sequence: Syntheticoligonucleotide
  misc_feature 1..22: note = MG3-6 AAVS1 GuideG1
  source 1..22: mol_type = other DNA
ggctccatcgtaagcaaacctt

SEQ ID NO: 6129 - DNA, 22 bp, synthetic construct
  misc_feature 1..22: note = Description of Artificial Sequence: Syntheticoligonucleotide
  misc_feature 1..22: note = MG3-6 AAVS1 GuideH1
  source 1..22: mol_type = other DNA
ggagagagatggctccaggaaa

SEQ ID NO: 6130 - DNA, 22 bp, synthetic construct
  misc_feature 1..22: note = Description of Artificial Sequence: Syntheticoligonucleotide
  misc_feature 1..22: note = MG3-6 AAVS1 GuideA2
  source 1..22: mol_type = other DNA
aaggaatctgcctaacaggagg

SEQ ID NO: 6131 - DNA, 22 bp, synthetic construct
  misc_feature 1..22: note = Description of Artificial Sequence: Syntheticoligonucleotide
  misc_feature 1..22: note = MG3-6 AAVS1 GuideB2
  source 1..22: mol_type = other DNA
aggaatctgcctaacaggaggt

SEQ ID NO: 6132 - DNA, 22 bp, synthetic construct
  misc_feature 1..22: note = Description of Artificial Sequence: Syntheticoligonucleotide
  misc_feature 1..22: note = MG3-6 AAVS1 GuideC2
  source 1..22: mol_type = other DNA
ggagactaggaaggaggaggcc

SEQ ID NO: 6133 - DNA, 22 bp, synthetic construct
  misc_feature 1..22: note = Description of Artificial Sequence: Syntheticoligonucleotide
  misc_feature 1..22: note = MG3-6 AAVS1 GuideD2
  source 1..22: mol_type = other DNA
taggaaggaggaggcctaagga

SEQ ID NO: 6134 - DNA, 22 bp, synthetic construct
  misc_feature 1..22: note = Description of Artificial Sequence: Syntheticoligonucleotide
  misc_feature 1..22: note = MG3-6 AAVS1 GuideE2
  source 1..22: mol_type = other DNA
tcctgtccctagtggccccact

SEQ ID NO: 6135 - DNA, 22 bp, synthetic construct
  misc_feature 1..22: note = Description of Artificial Sequence: Syntheticoligonucleotide
  misc_feature 1..22: note = MG3-6 AAVS1 GuideF2
  source 1..22: mol_type = other DNA
aaggtggtcccagctcggggac

SEQ ID NO: 6136 - DNA, 22 bp, synthetic construct
  misc_feature 1..22: note = Description of Artificial Sequence: Syntheticoligonucleotide
  misc_feature 1..22: note = MG3-6 AAVS1 GuideG2
  source 1..22: mol_type = other DNA
gtcctgaagtggacataggggc

SEQ ID NO: 6137 - DNA, 22 bp, synthetic construct
  misc_feature 1..22: note = Description of Artificial Sequence: Syntheticoligonucleotide
  misc_feature 1..22: note = MG3-6 AAVS1 GuideH2
  source 1..22: mol_type = other DNA
acccctggaagatgccatgaca

SEQ ID NO: 6138 - DNA, 22 bp, synthetic construct
  misc_feature 1..22: note = Description of Artificial Sequence: Syntheticoligonucleotide
  misc_feature 1..22: note = MG3-6 AAVS1 GuideA3
  source 1..22: mol_type = other DNA
ctagcacagactagagaggtaa

SEQ ID NO: 6139 - DNA, 22 bp, synthetic construct
  misc_feature 1..22: note = Description of Artificial Sequence: Syntheticoligonucleotide
  misc_feature 1..22: note = MG3-6 AAVS1 GuideB3
  source 1..22: mol_type = other DNA
ggtgacccgaatccacaggaga

SEQ ID NO: 6140 - DNA, 22 bp, synthetic construct
  misc_feature 1..22: note = Description of Artificial Sequence: Syntheticoligonucleotide
  misc_feature 1..22: note = MG3-6 AAVS1 GuideC3
  source 1..22: mol_type = other DNA
gggtgtccaggcaaagaaagca

SEQ ID NO: 6141 - DNA, 22 bp, synthetic construct
  misc_feature 1..22: note = Description of Artificial Sequence: Syntheticoligonucleotide
  misc_feature 1..22: note = MG3-6 AAVS1 GuideD3
  source 1..22: mol_type = other DNA
agaggtggctaaagccagggag

SEQ ID NO: 6142 - DNA, 22 bp, synthetic construct
  misc_feature 1..22: note = Description of Artificial Sequence: Syntheticoligonucleotide
  misc_feature 1..22: note = MG3-6 AAVS1 GuideE3
  source 1..22: mol_type = other DNA
aaagccagggagacggggtact

SEQ ID NO: 6143 - DNA, 22 bp, synthetic construct
  misc_feature 1..22: note = Description of Artificial Sequence: Syntheticoligonucleotide
  misc_feature 1..22: note = MG3-6 AAVS1 GuideF3
  source 1..22: mol_type = other DNA
aagccagggagacggggtactt

SEQ ID NO: 6144 - DNA, 22 bp, synthetic construct
  misc_feature 1..22: note = Description of Artificial Sequence: Syntheticoligonucleotide
  misc_feature 1..22: note = MG3-6 AAVS1 GuideG3
  source 1..22: mol_type = other DNA
ggcctgtgccatctctcgtttc

SEQ ID NO: 6145 - DNA, 22 bp, synthetic construct
  misc_feature 1..22: note = Description of Artificial Sequence: Syntheticoligonucleotide
  misc_feature 1..22: note = MG3-6 AAVS1 GuideH3
  source 1..22: mol_type = other DNA
agccccctgtcatggcatcttc

SEQ ID NO: 6146 - DNA, 22 bp, synthetic construct
  misc_feature 1..22: note = Description of Artificial Sequence: Syntheticoligonucleotide
  misc_feature 1..22: note = MG3-6 AAVS1 GuideA4
  source 1..22: mol_type = other DNA
aggacagcatgtttgctgcctc

SEQ ID NO: 6147 - DNA, 22 bp, synthetic construct
  misc_feature 1..22: note = Description of Artificial Sequence: Syntheticoligonucleotide
  misc_feature 1..22: note = MG3-6 AAVS1 GuideB4
  source 1..22: mol_type = other DNA
ccccacagtggggccactaggg

SEQ ID NO: 6148 - DNA, 22 bp, synthetic construct
  misc_feature 1..22: note = Description of Artificial Sequence: Syntheticoligonucleotide
  misc_feature 1..22: note = MG3-6 AAVS1 GuideC4
  source 1..22: mol_type = other DNA
tctctctccttgccagaacctc

SEQ ID NO: 6149 - DNA, 22 bp, synthetic construct
  misc_feature 1..22: note = Description of Artificial Sequence: Syntheticoligonucleotide
  misc_feature 1..22: note = MG3-6 AAVS1 GuideD4
  source 1..22: mol_type = other DNA
ggtttgcttacgatggagccag

SEQ ID NO: 6150 - DNA, 22 bp, synthetic construct
  misc_feature 1..22: note = Description of Artificial Sequence: Syntheticoligonucleotide
  misc_feature 1..22: note = MG3-6 AAVS1 GuideE4
  source 1..22: mol_type = other DNA
atcctgggagggagagcttggc

SEQ ID NO: 6151 - DNA, 22 bp, synthetic construct
  misc_feature 1..22: note = Description of Artificial Sequence: Syntheticoligonucleotide
  misc_feature 1..22: note = MG3-6 AAVS1 GuideF4
  source 1..22: mol_type = other DNA
tggcagggggtgggagggaagg

SEQ ID NO: 6152 - DNA, 22 bp, synthetic construct
  misc_feature 1..22: note = Description of Artificial Sequence: Syntheticoligonucleotide
  misc_feature 1..22: note = MG3-6 AAVS1 GuideG4
  source 1..22: mol_type = other DNA
ccagtagccagccccgtcctgg

SEQ ID NO: 6153 - DNA, 22 bp, synthetic construct
  misc_feature 1..22: note = Description of Artificial Sequence: Syntheticoligonucleotide
  misc_feature 1..22: note = MG3-6 TIGIT Guide A1
  source 1..22: mol_type = other DNA
tgcgctggtgtctcctcctgat

SEQ ID NO: 6154 - DNA, 22 bp, synthetic construct
  misc_feature 1..22: note = Description of Artificial Sequence: Syntheticoligonucleotide
  misc_feature 1..22: note = MG3-6 TIGIT Guide B1
  source 1..22: mol_type = other DNA
tgtctcctcctgatctgggccc

SEQ ID NO: 6155 - DNA, 22 bp, synthetic construct
  misc_feature 1..22: note = Description of Artificial Sequence: Syntheticoligonucleotide
  misc_feature 1..22: note = MG3-6 TIGIT Guide C1
  source 1..22: mol_type = other DNA
tgatctgggcccaggggctgag

SEQ ID NO: 6156 - DNA, 22 bp, synthetic construct
  misc_feature 1..22: note = Description of Artificial Sequence: Syntheticoligonucleotide
  misc_feature 1..22: note = MG3-6 TIGIT Guide D1
  source 1..22: mol_type = other DNA
ggcaggctcccctcgcctcagg

SEQ ID NO: 6157 - DNA, 22 bp, synthetic construct
  misc_feature 1..22: note = Description of Artificial Sequence: Syntheticoligonucleotide
  misc_feature 1..22: note = MG3-6 TIGIT Guide E1
  source 1..22: mol_type = other DNA
cgaggggagcctgcctcagccc

SEQ ID NO: 6158 - DNA, 22 bp, synthetic construct
  misc_feature 1..22: note = Description of Artificial Sequence: Syntheticoligonucleotide
  misc_feature 1..22: note = MG3-6 TIGIT Guide F1
  source 1..22: mol_type = other DNA
gagcctgcctcagcccctgggc

SEQ ID NO: 6159 - DNA, 22 bp, synthetic construct
  misc_feature 1..22: note = Description of Artificial Sequence: Syntheticoligonucleotide
  misc_feature 1..22: note = MG3-6 TIGIT Guide G1
  source 1..22: mol_type = other DNA
cctccaccacggcacaagtgac

SEQ ID NO: 6160 - DNA, 22 bp, synthetic construct
  misc_feature 1..22: note = Description of Artificial Sequence: Syntheticoligonucleotide
  misc_feature 1..22: note = MG3-6 TIGIT Guide H1
  source 1..22: mol_type = other DNA
gacccaggtcaactgggagcag

SEQ ID NO: 6161 - DNA, 22 bp, synthetic construct
  misc_feature 1..22: note = Description of Artificial Sequence: Syntheticoligonucleotide
  misc_feature 1..22: note = MG3-6 TIGIT Guide A2
  source 1..22: mol_type = other DNA
gtggcacatctccccatccttc

SEQ ID NO: 6162 - DNA, 22 bp, synthetic construct
  misc_feature 1..22: note = Description of Artificial Sequence: Syntheticoligonucleotide
  misc_feature 1..22: note = MG3-6 TIGIT Guide B2
  source 1..22: mol_type = other DNA
atccttcaaggatcgagtggcc

SEQ ID NO: 6163 - DNA, 22 bp, synthetic construct
  misc_feature 1..22: note = Description of Artificial Sequence: Syntheticoligonucleotide
  misc_feature 1..22: note = MG3-6 TIGIT Guide C2
  source 1..22: mol_type = other DNA
tcgagtggccccaggtcccggc

SEQ ID NO: 6164 - DNA, 22 bp, synthetic construct
  misc_feature 1..22: note = Description of Artificial Sequence: Syntheticoligonucleotide
  misc_feature 1..22: note = MG3-6 TIGIT Guide D2
  source 1..22: mol_type = other DNA
cgtacactgggagaatcttcct

SEQ ID NO: 6165 - DNA, 22 bp, synthetic construct
  misc_feature 1..22: note = Description of Artificial Sequence: Syntheticoligonucleotide
  misc_feature 1..22: note = MG3-6 TIGIT Guide E2
  source 1..22: mol_type = other DNA
cagcaggaatacctgagctttc

SEQ ID NO: 6166 - DNA, 22 bp, synthetic construct
  misc_feature 1..22: note = Description of Artificial Sequence: Syntheticoligonucleotide
  misc_feature 1..22: note = MG3-6 TIGIT Guide F2
  source 1..22: mol_type = other DNA
ctgagctttctaggacctccag

SEQ ID NO: 6167 - DNA, 22 bp, synthetic construct
  misc_feature 1..22: note = Description of Artificial Sequence: Syntheticoligonucleotide
  misc_feature 1..22: note = MG3-6 TIGIT Guide G2
  source 1..22: mol_type = other DNA
ttcacggtcagcgactggaggg

SEQ ID NO: 6168 - DNA, 22 bp, synthetic construct
  misc_feature 1..22: note = Description of Artificial Sequence: Syntheticoligonucleotide
  misc_feature 1..22: note = MG3-6 TIGIT Guide H2
  source 1..22: mol_type = other DNA
gtcagcgactggagggtgaggc

SEQ ID NO: 6169 - DNA, 22 bp, synthetic construct
  misc_feature 1..22: note = Description of Artificial Sequence: Syntheticoligonucleotide
  misc_feature 1..22: note = MG3-6 TIGIT Guide A3
  source 1..22: mol_type = other DNA
gactggagggtgaggcccaggc

SEQ ID NO: 6170 - DNA, 22 bp, synthetic construct
  misc_feature 1..22: note = Description of Artificial Sequence: Syntheticoligonucleotide
  misc_feature 1..22: note = MG3-6 TIGIT Guide B3
  source 1..22: mol_type = other DNA
gggtgaggcccaggccgggacc

SEQ ID NO: 6171 - DNA, 22 bp, synthetic construct
  misc_feature 1..22: note = Description of Artificial Sequence: Syntheticoligonucleotide
  misc_feature 1..22: note = MG3-6 TIGIT Guide C3
  source 1..22: mol_type = other DNA
ggtcctgctgctcccagttgac

SEQ ID NO: 6172 - DNA, 22 bp, synthetic construct
  misc_feature 1..22: note = Description of Artificial Sequence: Syntheticoligonucleotide
  misc_feature 1..22: note = MG3-6 TIGIT Guide D3
  source 1..22: mol_type = other DNA
cctctagtggctgagcacggtg

SEQ ID NO: 6173 - DNA, 22 bp, synthetic construct
  misc_feature 1..22: note = Description of Artificial Sequence: Syntheticoligonucleotide
  misc_feature 1..22: note = MG3-6 TIGIT Guide E3
  source 1..22: mol_type = other DNA
tggctgagcacggtgccaggtt

SEQ ID NO: 6174 - DNA, 22 bp, synthetic construct
  misc_feature 1..22: note = Description of Artificial Sequence: Syntheticoligonucleotide
  misc_feature 1..22: note = MG3-6 TIGIT Guide F3
  source 1..22: mol_type = other DNA
gtccaggcagaagctgcacctg

SEQ ID NO: 6175 - DNA, 22 bp, synthetic construct
  misc_feature 1..22: note = Description of Artificial Sequence: Syntheticoligonucleotide
  misc_feature 1..22: note = MG3-6 TIGIT Guide G3
  source 1..22: mol_type = other DNA
gctctgtggagagcagcgggga

SEQ ID NO: 6176 - DNA, 22 bp, synthetic construct
  misc_feature 1..22: note = Description of Artificial Sequence: Syntheticoligonucleotide
  misc_feature 1..22: note = MG3-6 TIGIT Guide H3
  source 1..22: mol_type = other DNA
tgggtaactgcagcttcttcac

SEQ ID NO: 6177 - DNA, 22 bp, synthetic construct
  misc_feature 1..22: note = Description of Artificial Sequence: Syntheticoligonucleotide
  misc_feature 1..22: note = MG3-6 TIGIT Guide A4
  source 1..22: mol_type = other DNA
tctgtgaagaagctgcagttac

SEQ ID NO: 6178 - DNA, 22 bp, synthetic construct
  misc_feature 1..22: note = Description of Artificial Sequence: Syntheticoligonucleotide
  misc_feature 1..22: note = MG3-6 TIGIT Guide B4
  source 1..22: mol_type = other DNA
cttcctgggggtgagggagcac

SEQ ID NO: 6179 - DNA, 22 bp, synthetic construct
  misc_feature 1..22: note = Description of Artificial Sequence: Syntheticoligonucleotide
  misc_feature 1..22: note = MG3-6 TIGIT Guide C4
  source 1..22: mol_type = other DNA
tcctgtccagctgattttctcc

SEQ ID NO: 6180 - DNA, 22 bp, synthetic construct
  misc_feature 1..22: note = Description of Artificial Sequence: Syntheticoligonucleotide
  misc_feature 1..22: note = MG3-6 TIGIT Guide D4
  source 1..22: mol_type = other DNA
tcctgaggtcaccttccacaga

SEQ ID NO: 6181 - DNA, 22 bp, synthetic construct
  misc_feature 1..22: note = Description of Artificial Sequence: Syntheticoligonucleotide
  misc_feature 1..22: note = MG3-6 TIGIT Guide E4
  source 1..22: mol_type = other DNA
caccttccacagaatggattct

SEQ ID NO: 6182 - DNA, 22 bp, synthetic construct
  misc_feature 1..22: note = Description of Artificial Sequence: Syntheticoligonucleotide
  misc_feature 1..22: note = MG3-6 CD38 guide A1
  source 1..22: mol_type = other DNA
ctgaaattcatcctgagatgag

SEQ ID NO: 6183 - DNA, 22 bp, synthetic construct
  misc_feature 1..22: note = Description of Artificial Sequence: Syntheticoligonucleotide
  misc_feature 1..22: note = MG3-6 CD38 guide B1
  source 1..22: mol_type = other DNA
ttagtcgccaacccacctcatc

SEQ ID NO: 6184 - DNA, 22 bp, synthetic construct
  misc_feature 1..22: note = Description of Artificial Sequence: Syntheticoligonucleotide
  misc_feature 1..22: note = MG3-6 CD38 guide C1
  source 1..22: mol_type = other DNA
acgaccaccgcgagcaccacga

SEQ ID NO: 6185 - DNA, 22 bp, synthetic construct
  misc_feature 1..22: note = Description of Artificial Sequence: Syntheticoligonucleotide
  misc_feature 1..22: note = MG3-6 CD38 guide D1
  source 1..22: mol_type = other DNA
agcaccacgacgaggatcagga

SEQ ID NO: 6186 - DNA, 22 bp, synthetic construct
  misc_feature 1..22: note = Description of Artificial Sequence: Syntheticoligonucleotide
  misc_feature 1..22: note = MG3-6 CD38 guide E1
  source 1..22: mol_type = other DNA
ggatactgacgccaagacagag

SEQ ID NO: 6187 - DNA, 22 bp, synthetic construct
  misc_feature 1..22: note = Description of Artificial Sequence: Syntheticoligonucleotide
  misc_feature 1..22: note = MG3-6 CD38 guide F1
  source 1..22: mol_type = other DNA
gggctctcctagagagccggca

SEQ ID NO: 6188 - DNA, 22 bp, synthetic construct
  misc_feature 1..22: note = Description of Artificial Sequence: Syntheticoligonucleotide
  misc_feature 1..22: note = MG3-6 CD38 guide G1
  source 1..22: mol_type = other DNA
ggctctcctagagagccggcag

SEQ ID NO: 6189 - DNA, 22 bp, synthetic construct
  misc_feature 1..22: note = Description of Artificial Sequence: Syntheticoligonucleotide
  misc_feature 1..22: note = MG3-6 CD38 guide H1
  source 1..22: mol_type = other DNA
cagcagggtttgtccccggaca

SEQ ID NO: 6190 - DNA, 22 bp, synthetic construct
  misc_feature 1..22: note = Description of Artificial Sequence: Syntheticoligonucleotide
  misc_feature 1..22: note = MG3-6 CD38 guide A2
  source 1..22: mol_type = other DNA
gggctgaactcgcagttggcca

SEQ ID NO: 6191 - DNA, 22 bp, synthetic construct
  misc_feature 1..22: note = Description of Artificial Sequence: Syntheticoligonucleotide
  misc_feature 1..22: note = MG3-6 CD38 guide B2
  source 1..22: mol_type = other DNA
gcagttggccatagggctccag

SEQ ID NO: 6192 - DNA, 22 bp, synthetic construct
  misc_feature 1..22: note = Description of Artificial Sequence: Syntheticoligonucleotide
  misc_feature 1..22: note = MG3-6 CD38 guide C2
  source 1..22: mol_type = other DNA
cagttggccatagggctccagg

SEQ ID NO: 6193 - DNA, 22 bp, synthetic construct
  misc_feature 1..22: note = Description of Artificial Sequence: Syntheticoligonucleotide
  misc_feature 1..22: note = MG3-6 CD38 guide D2
  source 1..22: mol_type = other DNA
gacatgtagactgccaaagtgt

SEQ ID NO: 6194 - DNA, 22 bp, synthetic construct
  misc_feature 1..22: note = Description of Artificial Sequence: Syntheticoligonucleotide
  misc_feature 1..22: note = MG3-6 CD38 guide E2
  source 1..22: mol_type = other DNA
gccaaagtgtatgggatgcttt

SEQ ID NO: 6195 - DNA, 22 bp, synthetic construct
  misc_feature 1..22: note = Description of Artificial Sequence: Syntheticoligonucleotide
  misc_feature 1..22: note = MG3-6 CD38 guide F2
  source 1..22: mol_type = other DNA
atagtcttcttcagtaatgttg

SEQ ID NO: 6196 - DNA, 22 bp, synthetic construct
  misc_feature 1..22: note = Description of Artificial Sequence: Syntheticoligonucleotide
  misc_feature 1..22: note = MG3-6 CD38 guide G2
  source 1..22: mol_type = other DNA
gttcaccctggaggacacgctg

SEQ ID NO: 6197 - DNA, 22 bp, synthetic construct
  misc_feature 1..22: note = Description of Artificial Sequence: Syntheticoligonucleotide
  misc_feature 1..22: note = MG3-6 CD38 guide H2
  source 1..22: mol_type = other DNA
gtggtgaattcaacacttccag

SEQ ID NO: 6198 - DNA, 22 bp, synthetic construct
  misc_feature 1..22: note = Description of Artificial Sequence: Syntheticoligonucleotide
  misc_feature 1..22: note = MG3-6 CD38 guide A3
  source 1..22: mol_type = other DNA
aggtagcctagcagcgtgtcct

SEQ ID NO: 6199 - DNA, 22 bp, synthetic construct
  misc_feature 1..22: note = Description of Artificial Sequence: Syntheticoligonucleotide
  misc_feature 1..22: note = MG3-6 CD38 guide B3
  source 1..22: mol_type = other DNA
gtattctggaaaacggtttccc

SEQ ID NO: 6200 - DNA, 22 bp, synthetic construct
  misc_feature 1..22: note = Description of Artificial Sequence: Syntheticoligonucleotide
  misc_feature 1..22: note = MG3-6 CD38 guide C3
  source 1..22: mol_type = other DNA
aaccgttttccagaatactgaa

SEQ ID NO: 6201 - DNA, 22 bp, synthetic construct
  misc_feature 1..22: note = Description of Artificial Sequence: Syntheticoligonucleotide
  misc_feature 1..22: note = MG3-6 CD38 guide D3
  source 1..22: mol_type = other DNA
accgttttccagaatactgaaa

SEQ ID NO: 6202 - DNA, 22 bp, synthetic construct
  misc_feature 1..22: note = Description of Artificial Sequence: Syntheticoligonucleotide
  misc_feature 1..22: note = MG3-6 CD38 guide E3
  source 1..22: mol_type = other DNA
tgtttttgtcaaagattttact

SEQ ID NO: 6203 - DNA, 22 bp, synthetic construct
  misc_feature 1..22: note = Description of Artificial Sequence: Syntheticoligonucleotide
  misc_feature 1..22: note = MG3-6 CD38 guide F3
  source 1..22: mol_type = other DNA
aagtccataatttgcaaccaga

SEQ ID NO: 6204 - DNA, 22 bp, synthetic construct
  misc_feature 1..22: note = Description of Artificial Sequence: Syntheticoligonucleotide
  misc_feature 1..22: note = MG3-6 CD38 guide G3
  source 1..22: mol_type = other DNA
ctttcttccccagagacttatg

SEQ ID NO: 6205 - DNA, 22 bp, synthetic construct
  misc_feature 1..22: note = Description of Artificial Sequence: Syntheticoligonucleotide
  misc_feature 1..22: note = MG3-6 CD38 guide H3
  source 1..22: mol_type = other DNA
aatcgattccagctcttttatg

SEQ ID NO: 6206 - DNA, 22 bp, synthetic construct
  misc_feature 1..22: note = Description of Artificial Sequence: Syntheticoligonucleotide
  misc_feature 1..22: note = MG3-6 CD38 guide A4
  source 1..22: mol_type = other DNA
ttcttcagtgtgtgaaaaatcc

SEQ ID NO: 6207 - DNA, 22 bp, synthetic construct
  misc_feature 1..22: note = Description of Artificial Sequence: Syntheticoligonucleotide
  misc_feature 1..22: note = MG3-6 CD38 guide B4
  source 1..22: mol_type = other DNA
ctcagatgtgcaagatgaatcc

SEQ ID NO: 6208 - DNA, 22 bp, synthetic construct
  misc_feature 1..22: note = Description of Artificial Sequence: Syntheticoligonucleotide
  misc_feature 1..22: note = MG3-6 CD38 guide C4
  source 1..22: mol_type = other DNA
cgggcaccaccaagcgctttcc

SEQ ID NO: 6209 - DNA, 22 bp, synthetic construct
  misc_feature 1..22: note = Description of Artificial Sequence: Syntheticoligonucleotide
  misc_feature 1..22: note = MG3-6 CD38 guide D4
  source 1..22: mol_type = other DNA
ctgaaattcatcctgagatgag

SEQ ID NO: 6210 - DNA, 22 bp, synthetic construct
  misc_feature 1..22: note = Description of Artificial Sequence: Syntheticoligonucleotide
  misc_feature 1..22: note = MG3-6 CD38 guide E4
  source 1..22: mol_type = other DNA
tcgggaaagcgcttggtggtgc

SEQ ID NO: 6211 - DNA, 22 bp, synthetic construct
  misc_feature 1..22: note = Description of Artificial Sequence: Syntheticoligonucleotide
  misc_feature 1..22: note = MG3-6 CD38 guide F4
  source 1..22: mol_type = other DNA
cgaccaccgcgagcaccacgac

SEQ ID NO: 6212 - DNA, 22 bp, synthetic construct
  misc_feature 1..22: note = Description of Artificial Sequence: Syntheticoligonucleotide
  misc_feature 1..22: note = MG3-6 CD38 guide G4
  source 1..22: mol_type = other DNA
ccgcgagcaccacgacgaggat

SEQ ID NO: 6213 - DNA, 22 bp, synthetic construct
  misc_feature 1..22: note = Description of Artificial Sequence: Syntheticoligonucleotide
  misc_feature 1..22: note = MG3-6 CD38 guide H4
  source 1..22: mol_type = other DNA
ggatactgacgccaagacagag

SEQ ID NO: 6214 - DNA, 22 bp, synthetic construct
  misc_feature 1..22: note = Description of Artificial Sequence: Syntheticoligonucleotide
  misc_feature 1..22: note = MG3-6 CD38 guide A5
  source 1..22: mol_type = other DNA
ggctctcctagagagccggcag

SEQ ID NO: 6215 - DNA, 22 bp, synthetic construct
  misc_feature 1..22: note = Description of Artificial Sequence: Syntheticoligonucleotide
  misc_feature 1..22: note = MG3-6 CD38 guide B5
  source 1..22: mol_type = other DNA
cagcagggtttgtccccggaca

SEQ ID NO: 6216 - DNA, 22 bp, synthetic construct
  misc_feature 1..22: note = Description of Artificial Sequence: Syntheticoligonucleotide
  misc_feature 1..22: note = MG3-6 CD38 guide C5
  source 1..22: mol_type = other DNA
gggctgaactcgcagttggcca

SEQ ID NO: 6217 - DNA, 22 bp, synthetic construct
  misc_feature 1..22: note = Description of Artificial Sequence: Syntheticoligonucleotide
  misc_feature 1..22: note = MG3-6 CD38 guide D5
  source 1..22: mol_type = other DNA
cagttggccatagggctccagg

SEQ ID NO: 6218 - DNA, 22 bp, synthetic construct
  misc_feature 1..22: note = Description of Artificial Sequence: Syntheticoligonucleotide
  misc_feature 1..22: note = MG3-6 CD38 guide E5
  source 1..22: mol_type = other DNA
ttctgtgttttatctcagacat

SEQ ID NO: 6219 - DNA, 22 bp, synthetic construct
  misc_feature 1..22: note = Description of Artificial Sequence: Syntheticoligonucleotide
  misc_feature 1..22: note = MG3-6 CD38 guide F5
  source 1..22: mol_type = other DNA
acatccttgcaacattactgaa

SEQ ID NO: 6220 - DNA, 22 bp, synthetic construct
  misc_feature 1..22: note = Description of Artificial Sequence: Syntheticoligonucleotide
  misc_feature 1..22: note = MG3-6 CD38 guide G5
  source 1..22: mol_type = other DNA
agccactaatgaagttgggaac

SEQ ID NO: 6221 - DNA, 22 bp, synthetic construct
  misc_feature 1..22: note = Description of Artificial Sequence: Syntheticoligonucleotide
  misc_feature 1..22: note = MG3-6 CD38 guide H5
  source 1..22: mol_type = other DNA
gattcttctttggagcagaata

SEQ ID NO: 6222 - DNA, 22 bp, synthetic construct
  misc_feature 1..22: note = Description of Artificial Sequence: Syntheticoligonucleotide
  misc_feature 1..22: note = MG3-6 CD38 guide A6
  source 1..22: mol_type = other DNA
aagatctggcccatcagttcac

SEQ ID NO: 6223 - DNA, 22 bp, synthetic construct
  misc_feature 1..22: note = Description of Artificial Sequence: Syntheticoligonucleotide
  misc_feature 1..22: note = MG3-6 CD38 guide B6
  source 1..22: mol_type = other DNA
gttcaccctggaggacacgctg

SEQ ID NO: 6224 - DNA, 22 bp, synthetic construct
  misc_feature 1..22: note = Description of Artificial Sequence: Syntheticoligonucleotide
  misc_feature 1..22: note = MG3-6 CD38 guide C6
  source 1..22: mol_type = other DNA
gtggtgaattcaacacttccag

SEQ ID NO: 6225 - DNA, 22 bp, synthetic construct
  misc_feature 1..22: note = Description of Artificial Sequence: Syntheticoligonucleotide
  misc_feature 1..22: note = MG3-6 CD38 guide D6
  source 1..22: mol_type = other DNA
attcaacacttccagtgaggct

SEQ ID NO: 6226 - DNA, 22 bp, synthetic construct
  misc_feature 1..22: note = Description of Artificial Sequence: Syntheticoligonucleotide
  misc_feature 1..22: note = MG3-6 CD38 guide E6
  source 1..22: mol_type = other DNA
gtgttgaattcaccacaccatg

SEQ ID NO: 6227 - DNA, 22 bp, synthetic construct
  misc_feature 1..22: note = Description of Artificial Sequence: Syntheticoligonucleotide
  misc_feature 1..22: note = MG3-6 CD38 guide F6
  source 1..22: mol_type = other DNA
cctccagggtgaacatgtcccg

SEQ ID NO: 6228 - DNA, 22 bp, synthetic construct
  misc_feature 1..22: note = Description of Artificial Sequence: Syntheticoligonucleotide
  misc_feature 1..22: note = MG3-6 CD38 guide G6
  source 1..22: mol_type = other DNA
cccgctggacctgtgtgaactg

SEQ ID NO: 6229 - DNA, 22 bp, synthetic construct
  misc_feature 1..22: note = Description of Artificial Sequence: Syntheticoligonucleotide
  misc_feature 1..22: note = MG3-6 CD38 guide H6
  source 1..22: mol_type = other DNA
tggacctgtgtgaactgatggg

SEQ ID NO: 6230 - DNA, 22 bp, synthetic construct
  misc_feature 1..22: note = Description of Artificial Sequence: Syntheticoligonucleotide
  misc_feature 1..22: note = MG3-6 CD38 guide A7
  source 1..22: mol_type = other DNA
agaaataaactatcaatcttgc

SEQ ID NO: 6231 - DNA, 22 bp, synthetic construct
  misc_feature 1..22: note = Description of Artificial Sequence: Syntheticoligonucleotide
  misc_feature 1..22: note = MG3-6 CD38 guide B7
  source 1..22: mol_type = other DNA
tcaatcttgcccagactggaga

SEQ ID NO: 6232 - DNA, 22 bp, synthetic construct
  misc_feature 1..22: note = Description of Artificial Sequence: Syntheticoligonucleotide
  misc_feature 1..22: note = MG3-6 CD38 guide C7
  source 1..22: mol_type = other DNA
accgttttccagaatactgaaa

SEQ ID NO: 6233 - DNA, 22 bp, synthetic construct
  misc_feature 1..22: note = Description of Artificial Sequence: Syntheticoligonucleotide
  misc_feature 1..22: note = MG3-6 CD38 guide D7
  source 1..22: mol_type = other DNA
gcagtcctttctccagtctggg

SEQ ID NO: 6234 - DNA, 22 bp, synthetic construct
  misc_feature 1..22: note = Description of Artificial Sequence: Syntheticoligonucleotide
  misc_feature 1..22: note = MG3-6 CD38 guide E7
  source 1..22: mol_type = other DNA
gatgtggtccatgtgatgctca

SEQ ID NO: 6235 - DNA, 22 bp, synthetic construct
  misc_feature 1..22: note = Description of Artificial Sequence: Syntheticoligonucleotide
  misc_feature 1..22: note = MG3-6 CD38 guide F7
  source 1..22: mol_type = other DNA
taaatgtgtacctgtttttgtc

SEQ ID NO: 6236 - DNA, 22 bp, synthetic construct
  misc_feature 1..22: note = Description of Artificial Sequence: Syntheticoligonucleotide
  misc_feature 1..22: note = MG3-6 CD38 guide G7
  source 1..22: mol_type = other DNA
gtttttgtcaaagattttactg

SEQ ID NO: 6237 - DNA, 22 bp, synthetic construct
  misc_feature 1..22: note = Description of Artificial Sequence: Syntheticoligonucleotide
  misc_feature 1..22: note = MG3-6 CD38 guide H7
  source 1..22: mol_type = other DNA
tgcgggatccattgagcatcac

SEQ ID NO: 6238 - DNA, 22 bp, synthetic construct
  misc_feature 1..22: note = Description of Artificial Sequence: Syntheticoligonucleotide
  misc_feature 1..22: note = MG3-6 CD38 guide A8
  source 1..22: mol_type = other DNA
aagtccataatttgcaaccaga

SEQ ID NO: 6239 - DNA, 22 bp, synthetic construct
  misc_feature 1..22: note = Description of Artificial Sequence: Syntheticoligonucleotide
  misc_feature 1..22: note = MG3-6 CD38 guide B8
  source 1..22: mol_type = other DNA
aaccagagaaggttcagacact

SEQ ID NO: 6240 - DNA, 22 bp, synthetic construct
  misc_feature 1..22: note = Description of Artificial Sequence: Syntheticoligonucleotide
  misc_feature 1..22: note = MG3-6 CD38 guide C8
  source 1..22: mol_type = other DNA
ctgggtgatacatggtggaaga

SEQ ID NO: 6241 - DNA, 22 bp, synthetic construct
  misc_feature 1..22: note = Description of Artificial Sequence: Syntheticoligonucleotide
  misc_feature 1..22: note = MG3-6 CD38 guide D8
  source 1..22: mol_type = other DNA
cttctcttccaccatgtatcac

SEQ ID NO: 6242 - DNA, 22 bp, synthetic construct
  misc_feature 1..22: note = Description of Artificial Sequence: Syntheticoligonucleotide
  misc_feature 1..22: note = MG3-6 CD38 guide E8
  source 1..22: mol_type = other DNA
gaaccttctctggttgcaaatt

SEQ ID NO: 6243 - DNA, 22 bp, synthetic construct
  misc_feature 1..22: note = Description of Artificial Sequence: Syntheticoligonucleotide
  misc_feature 1..22: note = MG3-6 CD38 guide F8
  source 1..22: mol_type = other DNA
tttcttccccagagacttatgc

SEQ ID NO: 6244 - DNA, 22 bp, synthetic construct
  misc_feature 1..22: note = Description of Artificial Sequence: Syntheticoligonucleotide
  misc_feature 1..22: note = MG3-6 CD38 guide G8
  source 1..22: mol_type = other DNA
atcgattccagctcttttatgg

SEQ ID NO: 6245 - DNA, 22 bp, synthetic construct
  misc_feature 1..22: note = Description of Artificial Sequence: Syntheticoligonucleotide
  misc_feature 1..22: note = MG3-6 CD38 guide H8
  source 1..22: mol_type = other DNA
tcttcagtgtgtgaaaaatcct

SEQ ID NO: 6246 - DNA, 22 bp, synthetic construct
  misc_feature 1..22: note = Description of Artificial Sequence: Syntheticoligonucleotide
  misc_feature 1..22: note = MG3-6 CD38 guide A9
  source 1..22: mol_type = other DNA
ctgaggattcatcttgcacatc

SEQ ID NO: 6247 - DNA, 22 bp, synthetic construct
  misc_feature 1..22: note = Description of Artificial Sequence: Syntheticoligonucleotide
  misc_feature 1..22: note = MG3-6 CD38 guide B9
  source 1..22: mol_type = other DNA
tcagatgtgcaagatgaatcct

SEQ ID NO: 6248 - DNA, 22 bp, synthetic construct
  misc_feature 1..22: note = Description of Artificial Sequence: Syntheticoligonucleotide
  misc_feature 1..22: note = MG3-6 CD38 guide C9
  source 1..22: mol_type = other DNA
tttcacacactgaagaaacttg

SEQ ID NO: 6249 - DNA, 22 bp, synthetic construct
  misc_feature 1..22: note = Description of Artificial Sequence: Syntheticoligonucleotide
  misc_feature 1..22: note = MG3-8 CD38 Guide A1
  source 1..22: mol_type = other DNA
ctgaaattcatcctgagatgag

SEQ ID NO: 6250 - DNA, 22 bp, synthetic construct
  misc_feature 1..22: note = Description of Artificial Sequence: Syntheticoligonucleotide
  misc_feature 1..22: note = MG3-8 CD38 Guide B1
  source 1..22: mol_type = other DNA
ggctctcctagagagccggcag

SEQ ID NO: 6251 - DNA, 22 bp, synthetic construct
  misc_feature 1..22: note = Description of Artificial Sequence: Syntheticoligonucleotide
  misc_feature 1..22: note = MG3-8 CD38 Guide C1
  source 1..22: mol_type = other DNA
cagttggccatagggctccagg

SEQ ID NO: 6252 - DNA, 22 bp, synthetic construct
  misc_feature 1..22: note = Description of Artificial Sequence: Syntheticoligonucleotide
  misc_feature 1..22: note = MG3-8 CD38 Guide D1
  source 1..22: mol_type = other DNA
aagatctggcccatcagttcac

SEQ ID NO: 6253 - DNA, 22 bp, synthetic construct
  misc_feature 1..22: note = Description of Artificial Sequence: Syntheticoligonucleotide
  misc_feature 1..22: note = MG3-8 CD38 Guide E1
  source 1..22: mol_type = other DNA
gtgttgaattcaccacaccatg

SEQ ID NO: 6254 - DNA, 22 bp, synthetic construct
  misc_feature 1..22: note = Description of Artificial Sequence: Syntheticoligonucleotide
  misc_feature 1..22: note = MG3-8 CD38 Guide F1
  source 1..22: mol_type = other DNA
accgttttccagaatactgaaa

SEQ ID NO: 6255 - DNA, 22 bp, synthetic construct
  misc_feature 1..22: note = Description of Artificial Sequence: Syntheticoligonucleotide
  misc_feature 1..22: note = MG3-8 CD38 Guide G1
  source 1..22: mol_type = other DNA
aagtccataatttgcaaccaga

SEQ ID NO: 6256 - DNA, 22 bp, synthetic construct
  misc_feature 1..22: note = Description of Artificial Sequence: Syntheticoligonucleotide
  misc_feature 1..22: note = MG3-8 CD38 Guide H1
  source 1..22: mol_type = other DNA
tttcacacactgaagaaacttg

SEQ ID NO: 6257 - protein, 1141 aa, unidentified
  REGION 1..1141: note = Description of Unknown:uncultivated organism with predicted taxonomy:Butyrivibrio sp. CAG:318
  REGION 1..1141: note = MG3a-4 active effector
MLSSLTCVDILRSHCRAKRKGAIVAECIYRVGIDVGDRSVGLVAVEFDENGVPLRFLEKLVVRHDGGLDPDTGKTPQSRKATAGVARRTRRMRKRKRQRLKALDRYLAEHGYPDVQPQITPYDAWHARARLVSTKVDDPAQLKNDLALALRHIARHRGWRNPWKTLASTRKLPVPSETLLANQARAREHFGDEVNDSTTVGQIGALAASRDYLLRPRNITVTKGVNQKKNVNDLERSSEEALAAGHPTAPILGWQVRQEDQINEVERIWERQGLPSEELPQILTLLFAQTKPHVPSERVGRDALQPKLYRAPIAALEFQDFRILAAIANLRVRTEGGRRLTKDERFTAFQFMSGWREKEPLSWADVAEELGFSAHALAAPTTETNQRLAFAPTNRTLTTLGTFFKGKKIDAGAREWWQSASYAERSLLAQLIADATPDTQEQADASGLSDVLLQWDEDTVADLMELDLQSGRAAYSTDTLLRLNARMENDGTDLFESIQAEFNIDPSRLPRPDWDDQTGQPTVDRVLTIVRRFVGGCERKYGKPESVTVEHVRTGLMGAEQRSSIIAENNRNRRDSDRIRAELQADGLSEPSRLDVRRHRQVQRQNCTCLYCGTPITTTTSELDHIVPRRGGGSSQGSNLVAVCRECNASKAHRIFAEWAEDSQREGVSVKEAAKRVRHWLNASASMKREVTRRLQQKRTDPPIDERDLASTSYAATEITRRILGHFHDEVPVVAFGGSGTREARRAGRVDHIIRLRGSLDKSRLDTRHHAIDAAVLTLQSPAIYRVLLTRVNLKHEHEVTGEAPEWRDYEGADQAEKVLYRRWQKNIATLAELMRQEIENNRVPVTRPIRLRKSRGAVHDATVMKALERDLWGEWDAQAIDRLVDPELHLALRKLFTSTKSKKIDVDATSQGLPERYLANQTVQLFDADAPSVMSPRGILRIGAGTHHARLLTWDDPKKGPQLGIQRVFAAEFGEILKDASSNDLFEAPIPFHTMSHRDLQPKVRAAVEQGLTRQIGWITQGDELEIDPADFVGEANAFGNFLREFPERSWSIAGLKKSNTIVIRPLLLSQEGVTAAISPHAAKIVENGIELSNSTLFTAPGTGIIRRTGLGRPRWDSGPAHLPESFNVHARMTQQSARD

SEQ ID NO: 6258-6278 - skipped (21 entries)

SEQ ID NO: 6279 - RNA, 94 nt, synthetic construct
  misc_feature 1..94: note = Description of Artificial Sequence: Syntheticoligonucleotide
  misc_feature 1..94: note = MG1-2 sgRNA
  source 1..94: mol_type = other RNA
nnnnnnnnnnnnnnnnnnnngttttgacttgaaaaagtcttaactgatttagccccgcagtgaccactgcttgcacgtcactgcggggcctttt

SEQ ID NO: 6280 - RNA, 120 nt, synthetic construct
  misc_feature 1..120: note = Description of Artificial Sequence: Syntheticpolynucleotide
  misc_feature 1..120: note = MG2-5 sgRNA
  source 1..120: mol_type = other RNA
nnnnnnnnnnnnnnnnnnnnnnnngctttgccttgattccagaaatggaatcaagacaaagttagataacgcaaactgcgtccctatccgccaagcggatacacctgttcaaaagcgttt

SEQ ID NO: 6281 - RNA, 108 nt, synthetic construct
  misc_feature 1..108: note = Description of Artificial Sequence: Syntheticpolynucleotide
  misc_feature 1..108: note = MG2-52 sgRNA
  source 1..108: mol_type = other RNA
nnnnnnnnnnnnnnnnnnnnnnnngttttgccttgaaaaaggacaaaattagtggctcaaatttgaacactgcgcgttcatacggcacttcaaatatgaaagagtttt

SEQ ID NO: 6282 - RNA, 113 nt, synthetic construct
  misc_feature 1..113: note = Description of Artificial Sequence: Syntheticpolynucleotide
  misc_feature 1..113: note = MG3-3 sgRNA
  source 1..113: mol_type = other RNA
nnnnnnnnnnnnnnnnnnnngttgggaatcttgaaaaagattcccaataaggcacatttttagtgctgacttctcaccgtccagggttcattgaacaatgggcggtatgtttt

SEQ ID NO: 6283 - RNA, 124 nt, synthetic construct
  misc_feature 1..124: note = Description of Artificial Sequence: Syntheticpolynucleotide
  misc_feature 1..124: note = MG3-4 sgRNA
  source 1..124: mol_type = other RNA
nnnnnnnnnnnnnnnnnnnngttgagaatctttcattagaaataacgaaagattcttaataaggcgtccttccgatgctgacttctcaccgtccgttttccaataggagcgggcggtatgtttt

SEQ ID NO: 6284 - RNA, 116 nt, synthetic construct
  misc_feature 1..116: note = Description of Artificial Sequence: Syntheticpolynucleotide
  misc_feature 1..116: note = MG3a-1 sgRNA
  source 1..116: mol_type = other RNA
nnnnnnnnnnnnnnnnnnnngttgggaatcgtcactgaaaagtgacgattctcaacaaaagacttttgtcttgatttctttatcccccggcattttgtgccgggggattcgttatt

SEQ ID NO: 6285 - RNA, 97 nt, synthetic construct
  misc_feature 1..97: note = Description of Artificial Sequence: Syntheticoligonucleotide
  misc_feature 1..97: note = MG3a-4 sgRNA
  source 1..97: mol_type = other RNA
nnnnnnnnnnnnnnnnnnnngtttcaatgaaaattgaaataagcggtttcgtaccgtgaattctccagcccctcggtttaccggggggcttcgtttt

SEQ ID NO: 6286 - RNA, 137 nt, synthetic construct
  misc_feature 1..137: note = Description of Artificial Sequence: Syntheticpolynucleotide
  misc_feature 1..137: note = MG15-54 sgRNA
  source 1..137: mol_type = other RNA
nnnnnnnnnnnnnnnnnnnnnnnngttgtagttccctgaaaaacgaaagtatttcaggttcctgcaataaggtctagctgttatgctagtaccgcaaagctctggcggcttaccttcatggtaggtcgccatctttt

SEQ ID NO: 6287 - RNA, 125 nt, synthetic construct
  misc_feature 1..125: note = Description of Artificial Sequence: Syntheticpolynucleotide
  misc_feature 1..125: note = MG15-66 sgRNA
  source 1..125: mol_type = other RNA
nnnnnnnnnnnnnnnnnnnnnnnngttgtaattccctggaaacaggttattacaataaggtccaacaggactgttggtaccgtaaagatctaacggtgcgcctttgggcgcaccgttagagtttt

SEQ ID NO: 6288 - RNA, 127 nt, synthetic construct
  misc_feature 1..127: note = Description of Artificial Sequence: Syntheticpolynucleotide
  misc_feature 1..127: note = MG15-94 sgRNA
  source 1..127: mol_type = other RNA
nnnnnnnnnnnnnnnnnnnnnnnngttgtagttccctagaaataggttgttacaataaggtccggcaggagtgccggtaccgtaaagctctaacggcgtgcctattattaggtacgccgttatcttt

SEQ ID NO: 6289 - RNA, 118 nt, synthetic construct
  misc_feature 1..118: note = Description of Artificial Sequence: Syntheticpolynucleotide
  misc_feature 1..118: note = MG15-115 sgRNA
  source 1..118: mol_type = other RNA
nnnnnnnnnnnnnnnnnnnngttgtagttccctagaaataggttattacaataaggtccaacgtagttggtaccgcaaagctctaacggtatgccttttggcataccgttatcttttt

SEQ ID NO: 6290 - RNA, 124 nt, synthetic construct
  misc_feature 1..124: note = Description of Artificial Sequence: Syntheticpolynucleotide
  misc_feature 1..124: note = MG15-135 sgRNA
  source 1..124: mol_type = other RNA
nnnnnnnnnnnnnnnnnnnnnnnngttgtagttccctagaaataggttattacaataaggtccaacaggagtgttggtaccgcaaagctctaacggtacgcctattggcgtaccgttatctttt

SEQ ID NO: 6291 - RNA, 135 nt, synthetic construct
  misc_feature 1..135: note = Description of Artificial Sequence: Syntheticpolynucleotide
  misc_feature 1..135: note = MG21-12 sgRNA
  source 1..135: mol_type = other RNA
nnnnnnnnnnnnnnnnnnnnnnnngttgtagttccttattgaaaaataggttattacaataagacctggattttattgtaaaatctatgagtcgtaaagctctagctgtcctctaaagggcagctatcttcatat

SEQ ID NO: 6292 - RNA, 145 nt, synthetic construct
  misc_feature 1..145: note = Description of Artificial Sequence: Syntheticpolynucleotide
  misc_feature 1..145: note = MG21-73 sgRNA
  source 1..145: mol_type = other RNA
nnnnnnnnnnnnnnnnnnnnnnnngttataccacttcggtggcataagccgcttttattatagcatattgtcaggttctgtcaagagattttaaaaatattacacgacaattgtgcagcgtgacaattgcataagtaaatgtttt

SEQ ID NO: 6293 - RNA, 125 nt, synthetic construct
  misc_feature 1..125: note = Description of Artificial Sequence: Syntheticpolynucleotide
  misc_feature 1..125: note = MG22-2 sgRNA
  source 1..125: mol_type = other RNA
nnnnnnnnnnnnnnnnnnnnnnnngttgtgaattgcgaaagcaattcacaataaggattattccgttgtgaaaacatttaaagcggctttacagcacattgtgtttgtgaagtcgttttcttttt

SEQ ID NO: 6294 - RNA, 122 nt, synthetic construct
  misc_feature 1..122: note = Description of Artificial Sequence: Syntheticpolynucleotide
  misc_feature 1..122: note = MG22-3 sgRNA
  source 1..122: mol_type = other RNA
nnnnnnnnnnnnnnnnnnnnnnnngttgtgaattgcttgaaaaagcaattcgcaataaggattattccgttgtgaaaacatttcgagtggcttcgtgaatattcacgaagtcacttcgtttt

SEQ ID NO: 6295 - RNA, 119 nt, synthetic construct
  misc_feature 1..119: note = Description of Artificial Sequence: Syntheticpolynucleotide
  misc_feature 1..119: note = MG23-2 sgRNA
  source 1..119: mol_type = other RNA
nnnnnnnnnnnnnnnnnnnnnnnngtttgagaacctgaaaaggtgagtgcaaataaggttttaaccgacattgtttacgcacattggtgctataaaaaaggctttttaagccttttttt

SEQ ID NO: 6296 - RNA, 98 nt, synthetic construct
  misc_feature 1..98: note = Description of Artificial Sequence: Syntheticoligonucleotide
  misc_feature 1..98: note = MG23-3 sgRNA
  source 1..98: mol_type = other RNA
nnnnnnnnnnnnnnnnnnnngtttgagaacctgaaaaggtgagtgcaaataaggctttagccgacatcgtttacctgcattgtgcagtgacttttttt

SEQ ID NO: 6297 - RNA, 136 nt, synthetic construct
  misc_feature 1..136: note = Description of Artificial Sequence: Syntheticpolynucleotide
  misc_feature 1..136: note = MG40-3 sgRNA
  source 1..136: mol_type = other RNA
nnnnnnnnnnnnnnnnnnnnnnnngttataggttgcttctgaaaagaagcaaccgtttatataataaagaatattttctgtggggttttacgattatgtatcccctgatgccgtccccaaaacggggacggctttt

SEQ ID NO: 6298 - RNA, 146 nt, synthetic construct
  misc_feature 1..146: note = Description of Artificial Sequence: Syntheticpolynucleotide
  misc_feature 1..146: note = MG48-1 sgRNA
  source 1..146: mol_type = other RNA
nnnnnnnnnnnnnnnnnnnnnnnnnnnnnngttgcggattgacagaaatgtctggggttcgccccgttgcgtcgcaagacgcatatccgttaacaaggattttaatccaccaaataagagaccgaacttttgttcggtctcgtttt

SEQ ID NO: 6299 - RNA, 117 nt, synthetic construct
  misc_feature 1..117: note = Description of Artificial Sequence: Syntheticpolynucleotide
  misc_feature 1..117: note = MG48-3 sgRNA
  source 1..117: mol_type = other RNA
nnnnnnnnnnnnnnnnnnnnnnnnnnnnnngttgcggattgacttgaaaaagttgtccgttaacaaggaatttatttccaccaaataagggcgatgcttttgcatcgcctctttttg

SEQ ID NO: 6300 - RNA, 151 nt, synthetic construct
  misc_feature 1..151: note = Description of Artificial Sequence: Syntheticpolynucleotide
  misc_feature 1..151: note = MG50-1 sgRNA
  source 1..151: mol_type = other RNA
nnnnnnnnnnnnnnnnnnnnnnnngttgtagctccctctctgaaaagagccgttgctacaataaggccgtcattcatttgatgtgccgtggggtcactgtccggtcgcaagaccggacatcccctaaaccaccctcactccccatccattt

SEQ ID NO: 6301 - RNA, 149 nt, synthetic construct
  misc_feature 1..149: note = Description of Artificial Sequence: Syntheticpolynucleotide
  misc_feature 1..149: note = MG51-1 sgRNA
  source 1..149: mol_type = other RNA
nnnnnnnnnnnnnnnnnnnngttgtgggttgcggacaggcgaaagcctgcgcagcttctcataacaaggagttccgcaaggaattccgcaggcaaccactgtccttcgggacgtggacccaccttggccgcccgcaagggcggcctttt

SEQ ID NO: 6302-6303 - skipped (2 entries)

SEQ ID NO: 6304 - RNA, 118 nt, synthetic construct
  misc_feature 1..118: note = Description of Artificial Sequence: Syntheticpolynucleotide
  source 1..118: mol_type = other RNA
nnnnnnnnnnnnnnnnnnnnnngttgagaatctttcgaaagaaagattcttaataaggcatccttccgatgctgacttctcaccgtccggctcctcttaggaacgggcggtatgtttt

SEQ ID NO: 6305 - RNA, 110 nt, synthetic construct
  misc_feature 1..110: note = Description of Artificial Sequence: Syntheticpolynucleotide
  source 1..110: mol_type = other RNA
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 1: mod_base = cm
  modified_base 2: mod_base = gm
  modified_base 3: mod_base = cm
cgctactctctctttctggcctgttgagaatcgaaagattcttaataaggcatccttccgatgctgacttctcaccgtccgttttccaataggagcgggcggtatgtttt

SEQ ID NO: 6306 - RNA, 110 nt, synthetic construct
  source 1..110: mol_type = other RNA
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 1: mod_base = OTHER; note = 2' O-methyladenosine
  modified_base 2: mod_base = gm
  modified_base 3: mod_base = OTHER; note = 2' O-methyladenosine
agagactcacgctggatagcctgttgagaatcgaaagattcttaataaggcatccttccgatgctgacttctcaccgtccgttttccaataggagcgggcggtatgtttt

SEQ ID NO: 6307 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gagagagtagcgcgagcacagcgttgagaatcgaaagattcttaataaggcatccttccgatgctgacttctcaccgtccgttttccaataggagcgggcggtatgtttt

SEQ ID NO: 6308 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cccgatattcctcaggtactccgttgagaatcgaaagattcttaataaggcatccttccgatgctgacttctcaccgtccgttttccaataggagcgggcggtatgtttt

SEQ ID NO: 6309 - RNA, 110 nt, synthetic construct
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
attcctcaggtactccaaagatgttgagaatcgaaagattcttaataaggcatccttccgatgctgacttctcaccgtccgttttccaataggagcgggcggtatgtttt

SEQ ID NO: 6310 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aatttcctgaattgctatgtgtgttgagaatcgaaagattcttaataaggcatccttccgatgctgacttctcaccgtccgttttccaataggagcgggcggtatgtttt

SEQ ID NO: 6311 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gagaattgaaaaagtggagcatgttgagaatcgaaagattcttaataaggcatccttccgatgctgacttctcaccgtccgttttccaataggagcgggcggtatgtttt

SEQ ID NO: 6312 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcattcagacttgtctttcagcgttgagaatcgaaagattcttaataaggcatccttccgatgctgacttctcaccgtccgttttccaataggagcgggcggtatgtttt

SEQ ID NO: 6313 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agacttaccccacttaactatcgttgagaatcgaaagattcttaataaggcatccttccgatgctgacttctcaccgtccgttttccaataggagcgggcggtatgtttt

SEQ ID NO: 6314 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttcagtgtagtacaagagataggttgagaatcgaaagattcttaataaggcatccttccgatgctgacttctcaccgtccgttttccaataggagcgggcggtatgtttt

SEQ ID NO: 6315 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agttctccttggtggcccgccggttgagaatcgaaagattcttaataaggcatccttccgatgctgacttctcaccgtccgttttccaataggagcgggcggtatgtttt

SEQ ID NO: 6316 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtggcccgccgtggggctagtcgttgagaatcgaaagattcttaataaggcatccttccgatgctgacttctcaccgtccgttttccaataggagcgggcggtatgtttt

SEQ ID NO: 6317 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccgccgtggggctagtccaggggttgagaatcgaaagattcttaataaggcatccttccgatgctgacttctcaccgtccgttttccaataggagcgggcggtatgtttt

SEQ ID NO: 6318 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcccctttcggcggggagcagggttgagaatcgaaagattcttaataaggcatccttccgatgctgacttctcaccgtccgttttccaataggagcgggcggtatgtttt

SEQ ID NO: 6319 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gacctttggcctacggcgacgggttgagaatcgaaagattcttaataaggcatccttccgatgctgacttctcaccgtccgttttccaataggagcgggcggtatgtttt

SEQ ID NO: 6320 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcgtcgataagcgtcagagcgcgttgagaatcgaaagattcttaataaggcatccttccgatgctgacttctcaccgtccgttttccaataggagcgggcggtatgtttt

SEQ ID NO: 6321 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cgtcagagcgccgaggttgggggttgagaatcgaaagattcttaataaggcatccttccgatgctgacttctcaccgtccgttttccaataggagcgggcggtatgtttt

SEQ ID NO: 6322 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = um
  modified_base 109^110: mod_base = OTHER; note = phosphorothioate bond
gggtttctcttccgctctttcggttgagaatcgaaagattcttaataaggcatccttccgatgctgacttctcaccgtccgttttccaataggagcgggcggtatgtttt

SEQ ID NO: 6323 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcgcagctggagtgggggacgggttgagaatcgaaagattcttaataaggcatccttccgatgctgacttctcaccgtccgttttccaataggagcgggcggtatgtttt

SEQ ID NO: 6324 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gctcgtcccaaaggcgcggcgcgttgagaatcgaaagattcttaataaggcatccttccgatgctgacttctcaccgtccgttttccaataggagcgggcggtatgtttt

SEQ ID NO: 6325 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgtgaacgcgtggaggggcgctgttgagaatcgaaagattcttaataaggcatccttccgatgctgacttctcaccgtccgttttccaataggagcgggcggtatgtttt

SEQ ID NO: 6326 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtctgctgcggctctgcttcccgttgagaatcgaaagattcttaataaggcatccttccgatgctgacttctcaccgtccgttttccaataggagcgggcggtatgtttt

SEQ ID NO: 6327 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcttcccttagactggagagctgttgagaatcgaaagattcttaataaggcatccttccgatgctgacttctcaccgtccgttttccaataggagcgggcggtatgtttt

SEQ ID NO: 6328 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aagttcgcatgtcctagcacctgttgagaatcgaaagattcttaataaggcatccttccgatgctgacttctcaccgtccgttttccaataggagcgggcggtatgtttt

SEQ ID NO: 6329 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tcctagcacctctgggtctatggttgagaatcgaaagattcttaataaggcatccttccgatgctgacttctcaccgtccgttttccaataggagcgggcggtatgtttt

SEQ ID NO: 6330 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cctccccacggtgtggccccacgttgagaatcgaaagattcttaataaggcatccttccgatgctgacttctcaccgtccgttttccaataggagcgggcggtatgtttt

SEQ ID NO: 6331 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aagggaagcagagccgcagcaggttgagaatcgaaagattcttaataaggcatccttccgatgctgacttctcaccgtccgttttccaataggagcgggcggtatgtttt

SEQ ID NO: 6332 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcttacccgggcgacgcctcccgttgagaatcgaaagattcttaataaggcatccttccgatgctgacttctcaccgtccgttttccaataggagcgggcggtatgtttt

SEQ ID NO: 6333 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctccagctgcgctgggggagccgttgagaatcgaaagattcttaataaggcatccttccgatgctgacttctcaccgtccgttttccaataggagcgggcggtatgtttt

SEQ ID NO: 6334 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttgtcccgaccctcccgtcgccgttgagaatcgaaagattcttaataaggcatccttccgatgctgacttctcaccgtccgttttccaataggagcgggcggtatgtttt

SEQ ID NO: 6335 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gaccctcccgtcgccgtaggccgttgagaatcgaaagattcttaataaggcatccttccgatgctgacttctcaccgtccgttttccaataggagcgggcggtatgtttt

SEQ ID NO: 6336 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtgcgcacccccttccccactcgttgagaatcgaaagattcttaataaggcatccttccgatgctgacttctcaccgtccgttttccaataggagcgggcggtatgtttt

SEQ ID NO: 6337 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccaggccaccccgccgcttcccgttgagaatcgaaagattcttaataaggcatccttccgatgctgacttctcaccgtccgttttccaataggagcgggcggtatgtttt

SEQ ID NO: 6338 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gccgcttccccgagatccagccgttgagaatcgaaagattcttaataaggcatccttccgatgctgacttctcaccgtccgttttccaataggagcgggcggtatgtttt

SEQ ID NO: 6339 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccagccctggactagccccacggttgagaatcgaaagattcttaataaggcatccttccgatgctgacttctcaccgtccgttttccaataggagcgggcggtatgtttt

SEQ ID NO: 6340 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tcacggagcgagagagcacagcgttgagaatcgaaagattcttaataaggcatccttccgatgctgacttctcaccgtccgttttccaataggagcgggcggtatgtttt

SEQ ID NO: 6341 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agagggtgcagagcgggagagggttgagaatcgaaagattcttaataaggcatccttccgatgctgacttctcaccgtccgttttccaataggagcgggcggtatgtttt

SEQ ID NO: 6342 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aggaccagagcgggagggtagggttgagaatcgaaagattcttaataaggcatccttccgatgctgacttctcaccgtccgttttccaataggagcgggcggtatgtttt

SEQ ID NO: 6343 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cgagattgaagtcaagcctaacgttgagaatcgaaagattcttaataaggcatccttccgatgctgacttctcaccgtccgttttccaataggagcgggcggtatgtttt

SEQ ID NO: 6344 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agaaaaacgcctgccttctgcggttgagaatcgaaagattcttaataaggcatccttccgatgctgacttctcaccgtccgttttccaataggagcgggcggtatgtttt

SEQ ID NO: 6345 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tctccagagcaaactgggcggcgttgagaatcgaaagattcttaataaggcatccttccgatgctgacttctcaccgtccgttttccaataggagcgggcggtatgtttt

SEQ ID NO: 6346 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggccctgtggtcttttcgtacagttgagaatcgaaagattcttaataaggcatccttccgatgctgacttctcaccgtccgttttccaataggagcgggcggtatgtttt

SEQ ID NO: 6347 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
actttcggttttgaaaacatgagttgagaatcgaaagattcttaataaggcatccttccgatgctgacttctcaccgtccgttttccaataggagcgggcggtatgtttt

SEQ ID NO: 6348 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aaagaggaagccctctgtacgagttgagaatcgaaagattcttaataaggcatccttccgatgctgacttctcaccgtccgttttccaataggagcgggcggtatgtttt

SEQ ID NO: 6349 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agccctctgtacgaaaagaccagttgagaatcgaaagattcttaataaggcatccttccgatgctgacttctcaccgtccgttttccaataggagcgggcggtatgtttt

SEQ ID NO: 6350 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgcgctcccgcaaaagccctgggttgagaatcgaaagattcttaataaggcatccttccgatgctgacttctcaccgtccgttttccaataggagcgggcggtatgtttt

SEQ ID NO: 6351 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aaaagaaaagaaagaaagaagtgttgagaatcgaaagattcttaataaggcatccttccgatgctgacttctcaccgtccgttttccaataggagcgggcggtatgtttt

SEQ ID NO: 6352 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aaagataatccaagatggttacgttgagaatcgaaagattcttaataaggcatccttccgatgctgacttctcaccgtccgttttccaataggagcgggcggtatgtttt

SEQ ID NO: 6353 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
taccaagactgttgaggacgccgttgagaatcgaaagattcttaataaggcatccttccgatgctgacttctcaccgtccgttttccaataggagcgggcggtatgtttt

SEQ ID NO: 6354 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tccaaagtaatacatgccatgcgttgagaatcgaaagattcttaataaggcatccttccgatgctgacttctcaccgtccgttttccaataggagcgggcggtatgtttt

SEQ ID NO: 6355 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
attactttggaaattttcaaaagttgagaatcgaaagattcttaataaggcatccttccgatgctgacttctcaccgtccgttttccaataggagcgggcggtatgtttt

SEQ ID NO: 6356 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aaataagatttttttttaaatagttgagaatcgaaagattcttaataaggcatccttccgatgctgacttctcaccgtccgttttccaataggagcgggcggtatgtttt

SEQ ID NO: 6357 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgccaggtacttagaaagtgctgttgagaatcgaaagattcttaataaggcatccttccgatgctgacttctcaccgtccgttttccaataggagcgggcggtatgtttt

SEQ ID NO: 6358 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctcaacagtcttggtaaccatcgttgagaatcgaaagattcttaataaggcatccttccgatgctgacttctcaccgtccgttttccaataggagcgggcggtatgtttt

SEQ ID NO: 6359 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgatacttgtcctcttcttagagttgagaatcgaaagattcttaataaggcatccttccgatgctgacttctcaccgtccgttttccaataggagcgggcggtatgtttt

SEQ ID NO: 6360 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcttttaatgttatgaaaaaaagttgagaatcgaaagattcttaataaggcatccttccgatgctgacttctcaccgtccgttttccaataggagcgggcggtatgtttt

SEQ ID NO: 6361 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tatgaaaaaaatcaggtcttcagttgagaatcgaaagattcttaataaggcatccttccgatgctgacttctcaccgtccgttttccaataggagcgggcggtatgtttt

SEQ ID NO: 6362 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gattccccaatccacctcttgagttgagaatcgaaagattcttaataaggcatccttccgatgctgacttctcaccgtccgttttccaataggagcgggcggtatgtttt

SEQ ID NO: 6363 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggcagctactcctccttgtctggttgagaatcgaaagattcttaataaggcatccttccgatgctgacttctcaccgtccgttttccaataggagcgggcggtatgtttt

SEQ ID NO: 6364 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gctgtggggagaaggaggagtagttgagaatcgaaagattcttaataaggcatccttccgatgctgacttctcaccgtccgttttccaataggagcgggcggtatgtttt

SEQ ID NO: 6365 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tagaaacaccctatcattaagggttgagaatcgaaagattcttaataaggcatccttccgatgctgacttctcaccgtccgttttccaataggagcgggcggtatgtttt

SEQ ID NO: 6366 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aggctactagccccatcaagaggttgagaatcgaaagattcttaataaggcatccttccgatgctgacttctcaccgtccgttttccaataggagcgggcggtatgtttt

SEQ ID NO: 6367 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gaggtggattggggaatctaatgttgagaatcgaaagattcttaataaggcatccttccgatgctgacttctcaccgtccgttttccaataggagcgggcggtatgtttt

SEQ ID NO: 6368 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ataagaacatattaaatgcctcgttgagaatcgaaagattcttaataaggcatccttccgatgctgacttctcaccgtccgttttccaataggagcgggcggtatgtttt

SEQ ID NO: 6369 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
taaatgcctcagggatcagagcgttgagaatcgaaagattcttaataaggcatccttccgatgctgacttctcaccgtccgttttccaataggagcgggcggtatgtttt

SEQ ID NO: 6370 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctctctgtttgagggaaggcgggttgagaatcgaaagattcttaataaggcatccttccgatgctgacttctcaccgtccgttttccaataggagcgggcggtatgtttt

SEQ ID NO: 6371 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctaagaagaggacaagtatcaggttgagaatcgaaagattcttaataaggcatccttccgatgctgacttctcaccgtccgttttccaataggagcgggcggtatgtttt

SEQ ID NO: 6372 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cacctatccctgttgtattttagttgagaatcgaaagattcttaataaggcatccttccgatgctgacttctcaccgtccgttttccaataggagcgggcggtatgtttt

SEQ ID NO: 6373 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atttgccagctcttgtatgcatgttgagaatcgaaagattcttaataaggcatccttccgatgctgacttctcaccgtccgttttccaataggagcgggcggtatgtttt

SEQ ID NO: 6374 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gaaattaggtacaaagtcagaggttgagaatcgaaagattcttaataaggcatccttccgatgctgacttctcaccgtccgttttccaataggagcgggcggtatgtttt

SEQ ID NO: 6375 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tataaaacctcagcagaaataagttgagaatcgaaagattcttaataaggcatccttccgatgctgacttctcaccgtccgttttccaataggagcgggcggtatgtttt

SEQ ID NO: 6376 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgttgtttggtaagaacataccgttgagaatcgaaagattcttaataaggcatccttccgatgctgacttctcaccgtccgttttccaataggagcgggcggtatgtttt

SEQ ID NO: 6377 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aacaaaacctctttatttctgcgttgagaatcgaaagattcttaataaggcatccttccgatgctgacttctcaccgtccgttttccaataggagcgggcggtatgtttt

SEQ ID NO: 6378 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atttctgctgaggttttatatggttgagaatcgaaagattcttaataaggcatccttccgatgctgacttctcaccgtccgttttccaataggagcgggcggtatgtttt

SEQ ID NO: 6379 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcaaataccttaaatggttgaggttgagaatcgaaagattcttaataaggcatccttccgatgctgacttctcaccgtccgttttccaataggagcgggcggtatgtttt

SEQ ID NO: 6380 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ataaaatacaacagggataggtgttgagaatcgaaagattcttaataaggcatccttccgatgctgacttctcaccgtccgttttccaataggagcgggcggtatgtttt

SEQ ID NO: 6381 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aatggagtaatgcatgtgacaggttgagaatcgaaagattcttaataaggcatccttccgatgctgacttctcaccgtccgttttccaataggagcgggcggtatgtttt

SEQ ID NO: 6382 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acaggtgattgctgtaaactaggttgagaatcgaaagattcttaataaggcatccttccgatgctgacttctcaccgtccgttttccaataggagcgggcggtatgtttt

SEQ ID NO: 6383 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctttccaaaatgagaggcatgagttgagaatcgaaagattcttaataaggcatccttccgatgctgacttctcaccgtccgttttccaataggagcgggcggtatgtttt

SEQ ID NO: 6384 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aatattgccagggtatttcactgttgagaatcgaaagattcttaataaggcatccttccgatgctgacttctcaccgtccgttttccaataggagcgggcggtatgtttt

SEQ ID NO: 6385 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgccttttttgttttttttctagttgagaatcgaaagattcttaataaggcatccttccgatgctgacttctcaccgtccgttttccaataggagcgggcggtatgtttt

SEQ ID NO: 6386 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tctagcagtatcttctgtcactgttgagaatcgaaagattcttaataaggcatccttccgatgctgacttctcaccgtccgttttccaataggagcgggcggtatgtttt

SEQ ID NO: 6387 - DNA, 22 bp, unidentified
  misc_feature 1..22: note = Description of Unknown:MG3-6-B2M-target site-A1 sequence
  source 1..22: mol_type = other DNA
cgctactctctctttctggcct

SEQ ID NO: 6388 - DNA, 22 bp, unidentified
  misc_feature 1..22: note = Description of Unknown:MG3-6-B2M-target site-B1 sequence
  source 1..22: mol_type = other DNA
agagactcacgctggatagcct

SEQ ID NO: 6389 - DNA, 22 bp, unidentified
  misc_feature 1..22: note = Description of Unknown:MG3-6-B2M-target site-C1 sequence
  source 1..22: mol_type = other DNA
gagagagtagcgcgagcacagc

SEQ ID NO: 6390 - DNA, 22 bp, unidentified
  misc_feature 1..22: note = Description of Unknown:MG3-6-B2M-target site-D1 sequence
  source 1..22: mol_type = other DNA
cccgatattcctcaggtactcc

SEQ ID NO: 6391 - DNA, 22 bp, unidentified
  misc_feature 1..22: note = Description of Unknown:MG3-6-B2M-target site-E1 sequence
  source 1..22: mol_type = other DNA
attcctcaggtactccaaagat

SEQ ID NO: 6392 - DNA, 22 bp, unidentified
  misc_feature 1..22: note = Description of Unknown:MG3-6-B2M-target site-F1 sequence
  source 1..22: mol_type = other DNA
aatttcctgaattgctatgtgt

SEQ ID NO: 6393 - DNA, 22 bp, unidentified
  misc_feature 1..22: note = Description of Unknown:MG3-6-B2M-target site-G1 sequence
  source 1..22: mol_type = other DNA
gagaattgaaaaagtggagcat

SEQ ID NO: 6394 - DNA, 22 bp, unidentified
  misc_feature 1..22: note = Description of Unknown:MG3-6-B2M-target site-H1 sequence
  source 1..22: mol_type = other DNA
gcattcagacttgtctttcagc

SEQ ID NO: 6395 - DNA, 22 bp, unidentified
  misc_feature 1..22: note = Description of Unknown:MG3-6-B2M-target site-A2 sequence
  source 1..22: mol_type = other DNA
agacttaccccacttaactatc

SEQ ID NO: 6396 - DNA, 22 bp, unidentified
  misc_feature 1..22: note = Description of Unknown:MG3-6-B2M-target site-B2 sequence
  source 1..22: mol_type = other DNA
ttcagtgtagtacaagagatag

SEQ ID NO: 6397 - DNA, 22 bp, unidentified
  misc_feature 1..22: note = Description of Unknown:MG3-6-B2M-target site-C2 sequence
  source 1..22: mol_type = other DNA
agttctccttggtggcccgccg

SEQ ID NO: 6398 - DNA, 22 bp, unidentified
  misc_feature 1..22: note = Description of Unknown:MG3-6-B2M-target site-D2 sequence
  source 1..22: mol_type = other DNA
gtggcccgccgtggggctagtc

SEQ ID NO: 6399 - DNA, 22 bp, unidentified
  misc_feature 1..22: note = Description of Unknown:MG3-6-B2M-target site-E2 sequence
  source 1..22: mol_type = other DNA
ccgccgtggggctagtccaggg

SEQ ID NO: 6400 - DNA, 22 bp, unidentified
  misc_feature 1..22: note = Description of Unknown:MG3-6-B2M-target site-F2 sequence
  source 1..22: mol_type = other DNA
gcccctttcggcggggagcagg

SEQ ID NO: 6401 - DNA, 22 bp, unidentified
  misc_feature 1..22: note = Description of Unknown:MG3-6-B2M-target site-G2 sequence
  source 1..22: mol_type = other DNA
gacctttggcctacggcgacgg

SEQ ID NO: 6402 - DNA, 22 bp, unidentified
  misc_feature 1..22: note = Description of Unknown:MG3-6-B2M-target site-H2 sequence
  source 1..22: mol_type = other DNA
gcgtcgataagcgtcagagcgc

SEQ ID NO: 6403 - DNA, 22 bp, unidentified
  misc_feature 1..22: note = Description of Unknown:MG3-6-B2M-target site-A3 sequence
  source 1..22: mol_type = other DNA
cgtcagagcgccgaggttgggg

SEQ ID NO: 6404 - DNA, 22 bp, unidentified
  misc_feature 1..22: note = Description of Unknown:MG3-6-B2M-target site-B3 sequence
  source 1..22: mol_type = other DNA
gggtttctcttccgctctttcg

SEQ ID NO: 6405 - DNA, 22 bp, unidentified
  misc_feature 1..22: note = Description of Unknown:MG3-6-B2M-target site-C3 sequence
  source 1..22: mol_type = other DNA
gcgcagctggagtgggggacgg

SEQ ID NO: 6406 - DNA, 22 bp, unidentified
  misc_feature 1..22: note = Description of Unknown:MG3-6-B2M-target site-D3 sequence
  source 1..22: mol_type = other DNA
gctcgtcccaaaggcgcggcgc

SEQ ID NO: 6407 - DNA, 22 bp, unidentified
  misc_feature 1..22: note = Description of Unknown:MG3-6-B2M-target site-E3 sequence
  source 1..22: mol_type = other DNA
tgtgaacgcgtggaggggcgct

SEQ ID NO: 6408 - DNA, 22 bp, unidentified
  misc_feature 1..22: note = Description of Unknown:MG3-6-B2M-target site-F3 sequence
  source 1..22: mol_type = other DNA
gtctgctgcggctctgcttccc

SEQ ID NO: 6409 - DNA, 22 bp, unidentified
  misc_feature 1..22: note = Description of Unknown:MG3-6-B2M-target site-G3 sequence
  source 1..22: mol_type = other DNA
gcttcccttagactggagagct

SEQ ID NO: 6410 - DNA, 22 bp, unidentified
  misc_feature 1..22: note = Description of Unknown:MG3-6-B2M-target site-H3 sequence
  source 1..22: mol_type = other DNA
aagttcgcatgtcctagcacct

SEQ ID NO: 6411 - DNA, 22 bp, unidentified
  misc_feature 1..22: note = Description of Unknown:MG3-6-B2M-target site-A4 sequence
  source 1..22: mol_type = other DNA
tcctagcacctctgggtctatg

SEQ ID NO: 6412 - DNA, 22 bp, unidentified
  misc_feature 1..22: note = Description of Unknown:MG3-6-B2M-target site-B4 sequence
  source 1..22: mol_type = other DNA
cctccccacggtgtggccccac

SEQ ID NO: 6413 - DNA, 22 bp, unidentified
  misc_feature 1..22: note = Description of Unknown:MG3-6-B2M-target site-C4 sequence
  source 1..22: mol_type = other DNA
aagggaagcagagccgcagcag

SEQ ID NO: 6414 - DNA, 22 bp, unidentified
  misc_feature 1..22: note = Description of Unknown:MG3-6-B2M-target site-D4 sequence
  source 1..22: mol_type = other DNA
gcttacccgggcgacgcctccc

SEQ ID NO: 6415 - DNA, 22 bp, unidentified
  misc_feature 1..22: note = Description of Unknown:MG3-6-B2M-target site-E4 sequence
  source 1..22: mol_type = other DNA
ctccagctgcgctgggggagcc

SEQ ID NO: 6416 - DNA, 22 bp, unidentified
  misc_feature 1..22: note = Description of Unknown:MG3-6-B2M-target site-F4 sequence
  source 1..22: mol_type = other DNA
ttgtcccgaccctcccgtcgcc

SEQ ID NO: 6417 - DNA, 22 bp, unidentified
  misc_feature 1..22: note = Description of Unknown:MG3-6-B2M-target site-G4 sequence
  source 1..22: mol_type = other DNA
gaccctcccgtcgccgtaggcc

SEQ ID NO: 6418 - DNA, 22 bp, unidentified
  misc_feature 1..22: note = Description of Unknown:MG3-6-B2M-target site-H4 sequence
  source 1..22: mol_type = other DNA
gtgcgcacccccttccccactc

SEQ ID NO: 6419 - DNA, 22 bp, unidentified
  misc_feature 1..22: note = Description of Unknown:MG3-6-B2M-target site-A5 sequence
  source 1..22: mol_type = other DNA
ccaggccaccccgccgcttccc

SEQ ID NO: 6420 - DNA, 22 bp, unidentified
  misc_feature 1..22: note = Description of Unknown:MG3-6-B2M-target site-B5 sequence
  source 1..22: mol_type = other DNA
gccgcttccccgagatccagcc

SEQ ID NO: 6421 - DNA, 22 bp, unidentified
  misc_feature 1..22: note = Description of Unknown:MG3-6-B2M-target site-C5 sequence
  source 1..22: mol_type = other DNA
ccagccctggactagccccacg

SEQ ID NO: 6422 - DNA, 22 bp, unidentified
  misc_feature 1..22: note = Description of Unknown:MG3-6-B2M-target site-D5 sequence
  source 1..22: mol_type = other DNA
tcacggagcgagagagcacagc

SEQ ID NO: 6423 - DNA, 22 bp, unidentified
  misc_feature 1..22: note = Description of Unknown:MG3-6-B2M-target site-E5 sequence
  source 1..22: mol_type = other DNA
agagggtgcagagcgggagagg

SEQ ID NO: 6424 - DNA, 22 bp, unidentified
  misc_feature 1..22: note = Description of Unknown:MG3-6-B2M-target site-F5 sequence
  source 1..22: mol_type = other DNA
aggaccagagcgggagggtagg

SEQ ID NO: 6425 - DNA, 22 bp, unidentified
  misc_feature 1..22: note = Description of Unknown:MG3-6-B2M-target site-G5 sequence
  source 1..22: mol_type = other DNA
cgagattgaagtcaagcctaac

SEQ ID NO: 6426 - DNA, 22 bp, unidentified
  misc_feature 1..22: note = Description of Unknown:MG3-6-B2M-target site-H5 sequence
  source 1..22: mol_type = other DNA
agaaaaacgcctgccttctgcg

SEQ ID NO: 6427 - DNA, 22 bp, unidentified
  misc_feature 1..22: note = Description of Unknown:MG3-6-B2M-target site-A6 sequence
  source 1..22: mol_type = other DNA
tctccagagcaaactgggcggc

SEQ ID NO: 6428 - DNA, 22 bp, unidentified
  misc_feature 1..22: note = Description of Unknown:MG3-6-B2M-target site-B6 sequence
  source 1..22: mol_type = other DNA
ggccctgtggtcttttcgtaca

SEQ ID NO: 6429 - DNA, 22 bp, unidentified
  misc_feature 1..22: note = Description of Unknown:MG3-6-B2M-target site-C6 sequence
  source 1..22: mol_type = other DNA
actttcggttttgaaaacatga

SEQ ID NO: 6430 - DNA, 22 bp, unidentified
  misc_feature 1..22: note = Description of Unknown:MG3-6-B2M-target site-D6 sequence
  source 1..22: mol_type = other DNA
aaagaggaagccctctgtacga

SEQ ID NO: 6431 - DNA, 22 bp, unidentified
  misc_feature 1..22: note = Description of Unknown:MG3-6-B2M-target site-E6 sequence
  source 1..22: mol_type = other DNA
agccctctgtacgaaaagacca

SEQ ID NO: 6432 - DNA, 22 bp, unidentified
  misc_feature 1..22: note = Description of Unknown:MG3-6-B2M-target site-F6 sequence
  source 1..22: mol_type = other DNA
tgcgctcccgcaaaagccctgg

SEQ ID NO: 6433 - DNA, 22 bp, unidentified
  misc_feature 1..22: note = Description of Unknown:MG3-6-B2M-target site-G6 sequence
  source 1..22: mol_type = other DNA
aaaagaaaagaaagaaagaagt

SEQ ID NO: 6434 - DNA, 22 bp, unidentified
  misc_feature 1..22: note = Description of Unknown:MG3-6-B2M-target site-H6 sequence
  source 1..22: mol_type = other DNA
aaagataatccaagatggttac

SEQ ID NO: 6435 - DNA, 22 bp, unidentified
  misc_feature 1..22: note = Description of Unknown:MG3-6-B2M-target site-A7 sequence
  source 1..22: mol_type = other DNA
taccaagactgttgaggacgcc

SEQ ID NO: 6436 - DNA, 22 bp, unidentified
  misc_feature 1..22: note = Description of Unknown:MG3-6-B2M-target site-B7 sequence
  source 1..22: mol_type = other DNA
tccaaagtaatacatgccatgc

SEQ ID NO: 6437 - DNA, 22 bp, unidentified
  misc_feature 1..22: note = Description of Unknown:MG3-6-B2M-target site-C7 sequence
  source 1..22: mol_type = other DNA
attactttggaaattttcaaaa

SEQ ID NO: 6438 - DNA, 22 bp, unidentified
  misc_feature 1..22: note = Description of Unknown:MG3-6-B2M-target site-D7 sequence
  source 1..22: mol_type = other DNA
aaataagatttttttttaaata

SEQ ID NO: 6439 - DNA, 22 bp, unidentified
  misc_feature 1..22: note = Description of Unknown:MG3-6-B2M-target site-E7 sequence
  source 1..22: mol_type = other DNA
tgccaggtacttagaaagtgct

SEQ ID NO: 6440 - DNA, 22 bp, unidentified
  misc_feature 1..22: note = Description of Unknown:MG3-6-B2M-target site-F7 sequence
  source 1..22: mol_type = other DNA
ctcaacagtcttggtaaccatc

SEQ ID NO: 6441 - DNA, 22 bp, unidentified
  misc_feature 1..22: note = Description of Unknown:MG3-6-B2M-target site-G7 sequence
  source 1..22: mol_type = other DNA
tgatacttgtcctcttcttaga

SEQ ID NO: 6442 - DNA, 22 bp, unidentified
  misc_feature 1..22: note = Description of Unknown:MG3-6-B2M-target site-H7 sequence
  source 1..22: mol_type = other DNA
gcttttaatgttatgaaaaaaa

SEQ ID NO: 6443 - DNA, 22 bp, unidentified
  misc_feature 1..22: note = Description of Unknown:MG3-6-B2M-target site-A8 sequence
  source 1..22: mol_type = other DNA
tatgaaaaaaatcaggtcttca

SEQ ID NO: 6444 - DNA, 22 bp, unidentified
  misc_feature 1..22: note = Description of Unknown:MG3-6-B2M-target site-B8 sequence
  source 1..22: mol_type = other DNA
gattccccaatccacctcttga

SEQ ID NO: 6445 - DNA, 22 bp, unidentified
  misc_feature 1..22: note = Description of Unknown:MG3-6-B2M-target site-C8 sequence
  source 1..22: mol_type = other DNA
ggcagctactcctccttgtctg

SEQ ID NO: 6446 - DNA, 22 bp, unidentified
  misc_feature 1..22: note = Description of Unknown:MG3-6-B2M-target site-D8 sequence
  source 1..22: mol_type = other DNA
gctgtggggagaaggaggagta

SEQ ID NO: 6447 - DNA, 22 bp, unidentified
  misc_feature 1..22: note = Description of Unknown:MG3-6-B2M-target site-E8 sequence
  source 1..22: mol_type = other DNA
tagaaacaccctatcattaagg

SEQ ID NO: 6448 - DNA, 22 bp, unidentified
  misc_feature 1..22: note = Description of Unknown:MG3-6-B2M-target site-F8 sequence
  source 1..22: mol_type = other DNA
aggctactagccccatcaagag

SEQ ID NO: 6449 - DNA, 22 bp, unidentified
  misc_feature 1..22: note = Description of Unknown:MG3-6-B2M-target site-G8 sequence
  source 1..22: mol_type = other DNA
gaggtggattggggaatctaat

SEQ ID NO: 6450 - DNA, 22 bp, unidentified
  misc_feature 1..22: note = Description of Unknown:MG3-6-B2M-target site-H8 sequence
  source 1..22: mol_type = other DNA
ataagaacatattaaatgcctc

SEQ ID NO: 6451 - DNA, 22 bp, unidentified
  misc_feature 1..22: note = Description of Unknown:MG3-6-B2M-target site-A9 sequence
  source 1..22: mol_type = other DNA
taaatgcctcagggatcagagc

SEQ ID NO: 6452 - DNA, 22 bp, unidentified
  misc_feature 1..22: note = Description of Unknown:MG3-6-B2M-target site-B9 sequence
  source 1..22: mol_type = other DNA
ctctctgtttgagggaaggcgg

SEQ ID NO: 6453 - DNA, 22 bp, unidentified
  misc_feature 1..22: note = Description of Unknown:MG3-6-B2M-target site-C9 sequence
  source 1..22: mol_type = other DNA
ctaagaagaggacaagtatcag

SEQ ID NO: 6454 - DNA, 22 bp, unidentified
  misc_feature 1..22: note = Description of Unknown:MG3-6-B2M-target site-D9 sequence
  source 1..22: mol_type = other DNA
cacctatccctgttgtatttta

SEQ ID NO: 6455 - DNA, 22 bp, unidentified
  misc_feature 1..22: note = Description of Unknown:MG3-6-B2M-target site-E9 sequence
  source 1..22: mol_type = other DNA
atttgccagctcttgtatgcat

SEQ ID NO: 6456 - DNA, 22 bp, unidentified
  misc_feature 1..22: note = Description of Unknown:MG3-6-B2M-target site-F9 sequence
  source 1..22: mol_type = other DNA
gaaattaggtacaaagtcagag

SEQ ID NO: 6457 - DNA, 22 bp, unidentified
  misc_feature 1..22: note = Description of Unknown:MG3-6-B2M-target site-G9 sequence
  source 1..22: mol_type = other DNA
tataaaacctcagcagaaataa

SEQ ID NO: 6458 - DNA, 22 bp, unidentified
  misc_feature 1..22: note = Description of Unknown:MG3-6-B2M-target site-H9 sequence
  source 1..22: mol_type = other DNA
tgttgtttggtaagaacatacc

SEQ ID NO: 6459 - DNA, 22 bp, unidentified
  misc_feature 1..22: note = Description of Unknown:MG3-6-B2M-target site-A10 sequence
  source 1..22: mol_type = other DNA
aacaaaacctctttatttctgc

SEQ ID NO: 6460 - DNA, 22 bp, unidentified
  misc_feature 1..22: note = Description of Unknown:MG3-6-B2M-target site-B10 sequence
  source 1..22: mol_type = other DNA
atttctgctgaggttttatatg

SEQ ID NO: 6461 - DNA, 22 bp, unidentified
  misc_feature 1..22: note = Description of Unknown:MG3-6-B2M-target site-C10 sequence
  source 1..22: mol_type = other DNA
gcaaataccttaaatggttgag

SEQ ID NO: 6462 - DNA, 22 bp, unidentified
  misc_feature 1..22: note = Description of Unknown:MG3-6-B2M-target site-D10 sequence
  source 1..22: mol_type = other DNA
ataaaatacaacagggataggt

SEQ ID NO: 6463 - DNA, 22 bp, unidentified
  misc_feature 1..22: note = Description of Unknown:MG3-6-B2M-target site-E10 sequence
  source 1..22: mol_type = other DNA
aatggagtaatgcatgtgacag

SEQ ID NO: 6464 - DNA, 22 bp, unidentified
  misc_feature 1..22: note = Description of Unknown:MG3-6-B2M-target site-F10 sequence
  source 1..22: mol_type = other DNA
acaggtgattgctgtaaactag

SEQ ID NO: 6465 - DNA, 22 bp, unidentified
  misc_feature 1..22: note = Description of Unknown:MG3-6-B2M-target site-G10 sequence
  source 1..22: mol_type = other DNA
ctttccaaaatgagaggcatga

SEQ ID NO: 6466 - DNA, 22 bp, unidentified
  misc_feature 1..22: note = Description of Unknown:MG3-6-B2M-target site-H10 sequence
  source 1..22: mol_type = other DNA
aatattgccagggtatttcact

SEQ ID NO: 6467 - DNA, 22 bp, unidentified
  misc_feature 1..22: note = Description of Unknown:MG3-6-B2M-target site-A11 sequence
  source 1..22: mol_type = other DNA
tgccttttttgttttttttcta

SEQ ID NO: 6468 - DNA, 22 bp, unidentified
  misc_feature 1..22: note = Description of Unknown:MG3-6-B2M-target site-B11 sequence
  source 1..22: mol_type = other DNA
tctagcagtatcttctgtcact

SEQ ID NO: 6469 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agaacctgctgtgtaccagttagttgagaatcgaaagattcttaataaggcatccttccgatgctgacttctcaccgtccgttttccaataggagcgggcggtatgtttt

SEQ ID NO: 6470 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aactgtgctggacatgaaagctgttgagaatcgaaagattcttaataaggcatccttccgatgctgacttctcaccgtccgttttccaataggagcgggcggtatgtttt

SEQ ID NO: 6471 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aagctatggattccaagagcaagttgagaatcgaaagattcttaataaggcatccttccgatgctgacttctcaccgtccgttttccaataggagcgggcggtatgtttt

SEQ ID NO: 6472 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tcacctgccaagatatcttcaagttgagaatcgaaagattcttaataaggcatccttccgatgctgacttctcaccgtccgttttccaataggagcgggcggtatgtttt

SEQ ID NO: 6473 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agttttgtcagtgatgaacgttgttgagaatcgaaagattcttaataaggcatccttccgatgctgacttctcaccgtccgttttccaataggagcgggcggtatgtttt

SEQ ID NO: 6474 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gaacaggcagagggtgctgtccgttgagaatcgaaagattcttaataaggcatccttccgatgctgacttctcaccgtccgttttccaataggagcgggcggtatgtttt

SEQ ID NO: 6475 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cagagggtgctgtcctgagaccgttgagaatcgaaagattcttaataaggcatccttccgatgctgacttctcaccgtccgttttccaataggagcgggcggtatgtttt

SEQ ID NO: 6476 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aggatcttttaactggtacacagttgagaatcgaaagattcttaataaggcatccttccgatgctgacttctcaccgtccgttttccaataggagcgggcggtatgtttt

SEQ ID NO: 6477 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tttaactggtacacagcaggttgttgagaatcgaaagattcttaataaggcatccttccgatgctgacttctcaccgtccgttttccaataggagcgggcggtatgtttt

SEQ ID NO: 6478 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aggttctgggttctggatgtctgttgagaatcgaaagattcttaataaggcatccttccgatgctgacttctcaccgtccgttttccaataggagcgggcggtatgtttt

SEQ ID NO: 6479 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aactttcaaaacctgtcagttagttgagaatcgaaagattcttaataaggcatccttccgatgctgacttctcaccgtccgttttccaataggagcgggcggtatgtttt

SEQ ID NO: 6480 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cgaatcctcctgctgaaagtaggttgagaatcgaaagattcttaataaggcatccttccgatgctgacttctcaccgtccgttttccaataggagcgggcggtatgtttt

SEQ ID NO: 6481 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggatttaacctgctcatgacgcgttgagaatcgaaagattcttaataaggcatccttccgatgctgacttctcaccgtccgttttccaataggagcgggcggtatgtttt

SEQ ID NO: 6482 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctttcatgccttcttacctcaagttgagaatcgaaagattcttaataaggcatccttccgatgctgacttctcaccgtccgttttccaataggagcgggcggtatgtttt

SEQ ID NO: 6483 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gaccacagcctcagcgtcatgagttgagaatcgaaagattcttaataaggcatccttccgatgctgacttctcaccgtccgttttccaataggagcgggcggtatgtttt

SEQ ID NO: 6484 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
taaatccggctactttcagcaggttgagaatcgaaagattcttaataaggcatccttccgatgctgacttctcaccgtccgttttccaataggagcgggcggtatgtttt

SEQ ID NO: 6485 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aggattcggagtcccataactggttgagaatcgaaagattcttaataaggcatccttccgatgctgacttctcaccgtccgttttccaataggagcgggcggtatgtttt

SEQ ID NO: 6486 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ataactgacaggttttgaaagtgttgagaatcgaaagattcttaataaggcatccttccgatgctgacttctcaccgtccgttttccaataggagcgggcggtatgtttt

SEQ ID NO: 6487 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtacttcctcactccaggtctggttgagaatcgaaagattcttaataaggcatccttccgatgctgacttctcaccgtccgttttccaataggagcgggcggtatgtttt

SEQ ID NO: 6488 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccacctcgtcaagacggctgtcgttgagaatcgaaagattcttaataaggcatccttccgatgctgacttctcaccgtccgttttccaataggagcgggcggtatgtttt

SEQ ID NO: 6489 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tggccctgattcacaatcccacgttgagaatcgaaagattcttaataaggcatccttccgatgctgacttctcaccgtccgttttccaataggagcgggcggtatgtttt

SEQ ID NO: 6490 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttcacaatcccacctggatctcgttgagaatcgaaagattcttaataaggcatccttccgatgctgacttctcaccgtccgttttccaataggagcgggcggtatgtttt

SEQ ID NO: 6491 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctggatctcccagatttgtgaggttgagaatcgaaagattcttaataaggcatccttccgatgctgacttctcaccgtccgttttccaataggagcgggcggtatgtttt

SEQ ID NO: 6492 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cattcacaaaaaacggcagggggttgagaatcgaaagattcttaataaggcatccttccgatgctgacttctcaccgtccgttttccaataggagcgggcggtatgtttt

SEQ ID NO: 6493 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aacggcaggggcggggcttctcgttgagaatcgaaagattcttaataaggcatccttccgatgctgacttctcaccgtccgttttccaataggagcgggcggtatgtttt

SEQ ID NO: 6494 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gggcggggcttctcctggatctgttgagaatcgaaagattcttaataaggcatccttccgatgctgacttctcaccgtccgttttccaataggagcgggcggtatgtttt

SEQ ID NO: 6495 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atctgaagacccctcccccatggttgagaatcgaaagattcttaataaggcatccttccgatgctgacttctcaccgtccgttttccaataggagcgggcggtatgtttt

SEQ ID NO: 6496 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gttttttgttttttttttttttgttgagaatcgaaagattcttaataaggcatccttccgatgctgacttctcaccgtccgttttccaataggagcgggcggtatgtttt

SEQ ID NO: 6497 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggtgtagaaattatctcattgtgttgagaatcgaaagattcttaataaggcatccttccgatgctgacttctcaccgtccgttttccaataggagcgggcggtatgtttt

SEQ ID NO: 6498 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggctcaatacacacagtagcaggttgagaatcgaaagattcttaataaggcatccttccgatgctgacttctcaccgtccgttttccaataggagcgggcggtatgtttt

SEQ ID NO: 6499 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
attttttttacaacattctccagttgagaatcgaaagattcttaataaggcatccttccgatgctgacttctcaccgtccgttttccaataggagcgggcggtatgtttt

SEQ ID NO: 6500 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acaggggagtctgccatggggggttgagaatcgaaagattcttaataaggcatccttccgatgctgacttctcaccgtccgttttccaataggagcgggcggtatgtttt

SEQ ID NO: 6501 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtctgccatgggggaggggtctgttgagaatcgaaagattcttaataaggcatccttccgatgctgacttctcaccgtccgttttccaataggagcgggcggtatgtttt

SEQ ID NO: 6502 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agcaaccttcctcacaaatctggttgagaatcgaaagattcttaataaggcatccttccgatgctgacttctcaccgtccgttttccaataggagcgggcggtatgtttt

SEQ ID NO: 6503 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tcacaaatctgggagatccagggttgagaatcgaaagattcttaataaggcatccttccgatgctgacttctcaccgtccgttttccaataggagcgggcggtatgtttt

SEQ ID NO: 6504 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agatccaggtgggattgtgaatgttgagaatcgaaagattcttaataaggcatccttccgatgctgacttctcaccgtccgttttccaataggagcgggcggtatgtttt

SEQ ID NO: 6505 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgggattgtgaatcagggccaagttgagaatcgaaagattcttaataaggcatccttccgatgctgacttctcaccgtccgttttccaataggagcgggcggtatgtttt

SEQ ID NO: 6506 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gacagccgtcttgacgaggtgggttgagaatcgaaagattcttaataaggcatccttccgatgctgacttctcaccgtccgttttccaataggagcgggcggtatgtttt

SEQ ID NO: 6507 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgaggaggatggagcttgggaggttgagaatcgaaagattcttaataaggcatccttccgatgctgacttctcaccgtccgttttccaataggagcgggcggtatgtttt

SEQ ID NO: 6508 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggagtcaggctctgtcagtcttgttgagaatcgaaagattcttaataaggcatccttccgatgctgacttctcaccgtccgttttccaataggagcgggcggtatgtttt

SEQ ID NO: 6509 - DNA, 22 bp, unidentified
  misc_feature 1..22: note = Description of Unknown:MG3-6-mTRAC-target site-A1 sequence
  source 1..22: mol_type = other DNA
agaacctgctgtgtaccagtta

SEQ ID NO: 6510 - DNA, 22 bp, unidentified
  misc_feature 1..22: note = Description of Unknown:MG3-6-mTRAC-target site-B1 sequence
  source 1..22: mol_type = other DNA
aactgtgctggacatgaaagct

SEQ ID NO: 6511 - DNA, 22 bp, unidentified
  misc_feature 1..22: note = Description of Unknown:MG3-6-mTRAC-target site-C1 sequence
  source 1..22: mol_type = other DNA
aagctatggattccaagagcaa

SEQ ID NO: 6512 - DNA, 22 bp, unidentified
  misc_feature 1..22: note = Description of Unknown:MG3-6-mTRAC-target site-D1 sequence
  source 1..22: mol_type = other DNA
tcacctgccaagatatcttcaa

SEQ ID NO: 6513 - DNA, 22 bp, unidentified
  misc_feature 1..22: note = Description of Unknown:MG3-6-mTRAC-target site-E1 sequence
  source 1..22: mol_type = other DNA
agttttgtcagtgatgaacgtt

SEQ ID NO: 6514 - DNA, 22 bp, unidentified
  misc_feature 1..22: note = Description of Unknown:MG3-6-mTRAC-target site-F1 sequence
  source 1..22: mol_type = other DNA
gaacaggcagagggtgctgtcc

SEQ ID NO: 6515 - DNA, 22 bp, unidentified
  misc_feature 1..22: note = Description of Unknown:MG3-6-mTRAC-target site-G1 sequence
  source 1..22: mol_type = other DNA
cagagggtgctgtcctgagacc

SEQ ID NO: 6516 - DNA, 22 bp, unidentified
  misc_feature 1..22: note = Description of Unknown:MG3-6-mTRAC-target site-H1 sequence
  source 1..22: mol_type = other DNA
aggatcttttaactggtacaca

SEQ ID NO: 6517 - DNA, 22 bp, unidentified
  misc_feature 1..22: note = Description of Unknown:MG3-6-mTRAC-target site-A2 sequence
  source 1..22: mol_type = other DNA
tttaactggtacacagcaggtt

SEQ ID NO: 6518 - DNA, 22 bp, unidentified
  misc_feature 1..22: note = Description of Unknown:MG3-6-mTRAC-target site-B2 sequence
  source 1..22: mol_type = other DNA
aggttctgggttctggatgtct

SEQ ID NO: 6519 - DNA, 22 bp, unidentified
  misc_feature 1..22: note = Description of Unknown:MG3-6-mTRAC-target site-C2 sequence
  source 1..22: mol_type = other DNA
aactttcaaaacctgtcagtta

SEQ ID NO: 6520 - DNA, 22 bp, unidentified
  misc_feature 1..22: note = Description of Unknown:MG3-6-mTRAC-target site-D2 sequence
  source 1..22: mol_type = other DNA
cgaatcctcctgctgaaagtag

SEQ ID NO: 6521 - DNA, 22 bp, unidentified
  misc_feature 1..22: note = Description of Unknown:MG3-6-mTRAC-target site-E2 sequence
  source 1..22: mol_type = other DNA
ggatttaacctgctcatgacgc

SEQ ID NO: 6522 - DNA, 22 bp, unidentified
  misc_feature 1..22: note = Description of Unknown:MG3-6-mTRAC-target site-F2 sequence
  source 1..22: mol_type = other DNA
ctttcatgccttcttacctcaa

SEQ ID NO: 6523 - DNA, 22 bp, unidentified
  misc_feature 1..22: note = Description of Unknown:MG3-6-mTRAC-target site-G2 sequence
  source 1..22: mol_type = other DNA
gaccacagcctcagcgtcatga

SEQ ID NO: 6524 - DNA, 22 bp, unidentified
  misc_feature 1..22: note = Description of Unknown:MG3-6-mTRAC-target site-H2 sequence
  source 1..22: mol_type = other DNA
taaatccggctactttcagcag

SEQ ID NO: 6525 - DNA, 22 bp, unidentified
  misc_feature 1..22: note = Description of Unknown:MG3-6-mTRAC-target site-A3 sequence
  source 1..22: mol_type = other DNA
aggattcggagtcccataactg

SEQ ID NO: 6526 - DNA, 22 bp, unidentified
  misc_feature 1..22: note = Description of Unknown:MG3-6-mTRAC-target site-B3 sequence
  source 1..22: mol_type = other DNA
ataactgacaggttttgaaagt

SEQ ID NO: 6527 - DNA, 22 bp, unidentified
  misc_feature 1..22: note = Description of Unknown:MG3-6-mTRAC-target site-C3 sequence
  source 1..22: mol_type = other DNA
gtacttcctcactccaggtctg

SEQ ID NO: 6528 - DNA, 22 bp, unidentified
  misc_feature 1..22: note = Description of Unknown:MG3-6-mTRAC-target site-D3 sequence
  source 1..22: mol_type = other DNA
ccacctcgtcaagacggctgtc

SEQ ID NO: 6529 - DNA, 22 bp, unidentified
  misc_feature 1..22: note = Description of Unknown:MG3-6-mTRAC-target site-E3 sequence
  source 1..22: mol_type = other DNA
tggccctgattcacaatcccac

SEQ ID NO: 6530 - DNA, 22 bp, unidentified
  misc_feature 1..22: note = Description of Unknown:MG3-6-mTRAC-target site-F3 sequence
  source 1..22: mol_type = other DNA
ttcacaatcccacctggatctc

SEQ ID NO: 6531 - DNA, 22 bp, unidentified
  misc_feature 1..22: note = Description of Unknown:MG3-6-mTRAC-target site-G3 sequence
  source 1..22: mol_type = other DNA
ctggatctcccagatttgtgag

SEQ ID NO: 6532 - DNA, 22 bp, unidentified
  misc_feature 1..22: note = Description of Unknown:MG3-6-mTRAC-target site-H3 sequence
  source 1..22: mol_type = other DNA
cattcacaaaaaacggcagggg

SEQ ID NO: 6533 - DNA, 22 bp, unidentified
  misc_feature 1..22: note = Description of Unknown:MG3-6-mTRAC-target site-A4 sequence
  source 1..22: mol_type = other DNA
aacggcaggggcggggcttctc

SEQ ID NO: 6534 - DNA, 22 bp, unidentified
  misc_feature 1..22: note = Description of Unknown:MG3-6-mTRAC-target site-B4 sequence
  source 1..22: mol_type = other DNA
gggcggggcttctcctggatct

SEQ ID NO: 6535 - DNA, 22 bp, unidentified
  misc_feature 1..22: note = Description of Unknown:MG3-6-mTRAC-target site-C4 sequence
  source 1..22: mol_type = other DNA
atctgaagacccctcccccatg

SEQ ID NO: 6536 - DNA, 22 bp, unidentified
  misc_feature 1..22: note = Description of Unknown:MG3-6-mTRAC-target site-D4 sequence
  source 1..22: mol_type = other DNA
gttttttgtttttttttttttt

SEQ ID NO: 6537 - DNA, 22 bp, unidentified
  misc_feature 1..22: note = Description of Unknown:MG3-6-mTRAC-target site-E4 sequence
  source 1..22: mol_type = other DNA
ggtgtagaaattatctcattgt

SEQ ID NO: 6538 - DNA, 22 bp, unidentified
  misc_feature 1..22: note = Description of Unknown:MG3-6-mTRAC-target site-F4 sequence
  source 1..22: mol_type = other DNA
ggctcaatacacacagtagcag

SEQ ID NO: 6539 - DNA, 22 bp, unidentified
  misc_feature 1..22: note = Description of Unknown:MG3-6-mTRAC-target site-G4 sequence
  source 1..22: mol_type = other DNA
attttttttacaacattctcca

SEQ ID NO: 6540 - DNA, 22 bp, unidentified
  misc_feature 1..22: note = Description of Unknown:MG3-6-mTRAC-target site-H4 sequence
  source 1..22: mol_type = other DNA
acaggggagtctgccatggggg

SEQ ID NO: 6541 - DNA, 22 bp, unidentified
  misc_feature 1..22: note = Description of Unknown:MG3-6-mTRAC-target site-A5 sequence
  source 1..22: mol_type = other DNA
gtctgccatgggggaggggtct

SEQ ID NO: 6542 - DNA, 22 bp, unidentified
  misc_feature 1..22: note = Description of Unknown:MG3-6-mTRAC-target site-B5 sequence
  source 1..22: mol_type = other DNA
agcaaccttcctcacaaatctg

SEQ ID NO: 6543 - DNA, 22 bp, unidentified
  misc_feature 1..22: note = Description of Unknown:MG3-6-mTRAC-target site-C5 sequence
  source 1..22: mol_type = other DNA
tcacaaatctgggagatccagg

SEQ ID NO: 6544 - DNA, 22 bp, unidentified
  misc_feature 1..22: note = Description of Unknown:MG3-6-mTRAC-target site-D5 sequence
  source 1..22: mol_type = other DNA
agatccaggtgggattgtgaat

SEQ ID NO: 6545 - DNA, 22 bp, unidentified
  misc_feature 1..22: note = Description of Unknown:MG3-6-mTRAC-target site-E5 sequence
  source 1..22: mol_type = other DNA
tgggattgtgaatcagggccaa

SEQ ID NO: 6546 - DNA, 22 bp, unidentified
  misc_feature 1..22: note = Description of Unknown:MG3-6-mTRAC-target site-F5 sequence
  source 1..22: mol_type = other DNA
gacagccgtcttgacgaggtgg

SEQ ID NO: 6547 - DNA, 22 bp, unidentified
  misc_feature 1..22: note = Description of Unknown:MG3-6-mTRAC-target site-G5 sequence
  source 1..22: mol_type = other DNA
tgaggaggatggagcttgggag

SEQ ID NO: 6548 - DNA, 22 bp, unidentified
  misc_feature 1..22: note = Description of Unknown:MG3-6-mTRAC-target site-H5 sequence
  source 1..22: mol_type = other DNA
ggagtcaggctctgtcagtctt

SEQ ID NO: 6549 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttcctctgcatcagttttaatggttgagaatcgaaagattcttaataaggcatccttccgatgctgacttctcaccgtccgttttccaataggagcgggcggtatgtttt

SEQ ID NO: 6550 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtgggcttgtgttctaaaggaggttgagaatcgaaagattcttaataaggcatccttccgatgctgacttctcaccgtccgttttccaataggagcgggcggtatgtttt

SEQ ID NO: 6551 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aggagtgagattggttttttgtgttgagaatcgaaagattcttaataaggcatccttccgatgctgacttctcaccgtccgttttccaataggagcgggcggtatgtttt

SEQ ID NO: 6552 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
taaaaaataatatttataatttgttgagaatcgaaagattcttaataaggcatccttccgatgctgacttctcaccgtccgttttccaataggagcgggcggtatgtttt

SEQ ID NO: 6553 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gagtatttttattgaaaagcatgttgagaatcgaaagattcttaataaggcatccttccgatgctgacttctcaccgtccgttttccaataggagcgggcggtatgtttt

SEQ ID NO: 6554 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aaaaatattttccctaacaaaggttgagaatcgaaagattcttaataaggcatccttccgatgctgacttctcaccgtccgttttccaataggagcgggcggtatgtttt

SEQ ID NO: 6555 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atctcagctatttagtcaaaaggttgagaatcgaaagattcttaataaggcatccttccgatgctgacttctcaccgtccgttttccaataggagcgggcggtatgtttt

SEQ ID NO: 6556 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = cm
  modified_base 1^2: mod_base = OTHER; note = phosphorothioate bond
  modified_base 2^3: mod_base = OTHER; mod_base = OTHER; note = phosphorothioate bond; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtcctacttttgactaaatagcgttgagaatcgaaagattcttaataaggcatccttccgatgctgacttctcaccgtccgttttccaataggagcgggcggtatgtttt

SEQ ID NO: 6557 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; mod_base = OTHER; note = phosphorothioate bond; note = phosphorothioate bond
aactctccaatataggtggctagttgagaatcgaaagattcttaataaggcatccttccgatgctgacttctcaccgtccgttttccaataggagcgggcggtatgtttt

SEQ ID NO: 6558 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atttttcccataaattcaagatgttgagaatcgaaagattcttaataaggcatccttccgatgctgacttctcaccgtccgttttccaataggagcgggcggtatgtttt

SEQ ID NO: 6559 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccaggactggattttgtaggtggttgagaatcgaaagattcttaataaggcatccttccgatgctgacttctcaccgtccgttttccaataggagcgggcggtatgtttt

SEQ ID NO: 6560 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgcacctacaaaatccagtcctgttgagaatcgaaagattcttaataaggcatccttccgatgctgacttctcaccgtccgttttccaataggagcgggcggtatgtttt

SEQ ID NO: 6561 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtaagaatgccagcccccaggagttgagaatcgaaagattcttaataaggcatccttccgatgctgacttctcaccgtccgttttccaataggagcgggcggtatgtttt

SEQ ID NO: 6562 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aagcagtaagaatgccagccccgttgagaatcgaaagattcttaataaggcatccttccgatgctgacttctcaccgtccgttttccaataggagcgggcggtatgtttt

SEQ ID NO: 6563 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gctggcattcttactgcttgctgttgagaatcgaaagattcttaataaggcatccttccgatgctgacttctcaccgtccgttttccaataggagcgggcggtatgtttt

SEQ ID NO: 6564 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgcttgctgagggccagatgatgttgagaatcgaaagattcttaataaggcatccttccgatgctgacttctcaccgtccgttttccaataggagcgggcggtatgtttt

SEQ ID NO: 6565 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atagattccagaatatctccatgttgagaatcgaaagattcttaataaggcatccttccgatgctgacttctcaccgtccgttttccaataggagcgggcggtatgtttt

SEQ ID NO: 6566 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgacagtattgcagttatacatgttgagaatcgaaagattcttaataaggcatccttccgatgctgacttctcaccgtccgttttccaataggagcgggcggtatgtttt

SEQ ID NO: 6567 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cgaaaagtaatgtaatctcatagttgagaatcgaaagattcttaataaggcatccttccgatgctgacttctcaccgtccgttttccaataggagcgggcggtatgtttt

SEQ ID NO: 6568 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggattatatcttaagtcttatagttgagaatcgaaagattcttaataaggcatccttccgatgctgacttctcaccgtccgttttccaataggagcgggcggtatgtttt

SEQ ID NO: 6569 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aacacatgacaaaattatttaagttgagaatcgaaagattcttaataaggcatccttccgatgctgacttctcaccgtccgttttccaataggagcgggcggtatgtttt

SEQ ID NO: 6570 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtttgtcctgaatagcatggcagttgagaatcgaaagattcttaataaggcatccttccgatgctgacttctcaccgtccgttttccaataggagcgggcggtatgtttt

SEQ ID NO: 6571 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctgaatagcatggcagaggattgttgagaatcgaaagattcttaataaggcatccttccgatgctgacttctcaccgtccgttttccaataggagcgggcggtatgtttt

SEQ ID NO: 6572 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atccttattcttaattttgcaagttgagaatcgaaagattcttaataaggcatccttccgatgctgacttctcaccgtccgttttccaataggagcgggcggtatgtttt

SEQ ID NO: 6573 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcccccttgcaaaattaagaatgttgagaatcgaaagattcttaataaggcatccttccgatgctgacttctcaccgtccgttttccaataggagcgggcggtatgtttt

SEQ ID NO: 6574 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; mod_base = OTHER; note = phosphorothioate bond; note = phosphorothioate bond
  modified_base 108^109: mod_base = OTHER; note = phosphorothioate bond
  modified_base 109^110: mod_base = OTHER; note = phosphorothioate bond
ggtgaggaagtgataggaaggggttgagaatcgaaagattcttaataaggcatccttccgatgctgacttctcaccgtccgttttccaataggagcgggcggtatgtttt

SEQ ID NO: 6575 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtgataggaaggggtgggccctgttgagaatcgaaagattcttaataaggcatccttccgatgctgacttctcaccgtccgttttccaataggagcgggcggtatgtttt

SEQ ID NO: 6576 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; mod_base = OTHER; note = phosphorothioate bond; note = phosphorothioate bond
ggaaggggtgggccctgaagatgttgagaatcgaaagattcttaataaggcatccttccgatgctgacttctcaccgtccgttttccaataggagcgggcggtatgtttt

SEQ ID NO: 6577 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aattccaggaggtccagatcttgttgagaatcgaaagattcttaataaggcatccttccgatgctgacttctcaccgtccgttttccaataggagcgggcggtatgtttt

SEQ ID NO: 6578 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; mod_base = OTHER; note = phosphorothioate bond; note = phosphorothioate bond
tcatcactcaattccaggaggtgttgagaatcgaaagattcttaataaggcatccttccgatgctgacttctcaccgtccgttttccaataggagcgggcggtatgtttt

SEQ ID NO: 6579 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cagcattcatcactcaattccagttgagaatcgaaagattcttaataaggcatccttccgatgctgacttctcaccgtccgttttccaataggagcgggcggtatgtttt

SEQ ID NO: 6580 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bondv
  modified_base 108^109: mod_base = OTHER; note = phosphorothioate bond
  modified_base 109^110: mod_base = OTHER; note = phosphorothioate bond
cagcataggtaaggtgaggagggttgagaatcgaaagattcttaataaggcatccttccgatgctgacttctcaccgtccgttttccaataggagcgggcggtatgtttt

SEQ ID NO: 6581 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acataaaaactgcagactgatcgttgagaatcgaaagattcttaataaggcatccttccgatgctgacttctcaccgtccgttttccaataggagcgggcggtatgtttt

SEQ ID NO: 6582 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = cm
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acctgacccctacataaaaactgttgagaatcgaaagattcttaataaggcatccttccgatgctgacttctcaccgtccgttttccaataggagcgggcggtatgtttt

SEQ ID NO: 6583 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gatcagtctgcagtttttatgtgttgagaatcgaaagattcttaataaggcatccttccgatgctgacttctcaccgtccgttttccaataggagcgggcggtatgtttt

SEQ ID NO: 6584 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tctgctttttcctaagtgattagttgagaatcgaaagattcttaataaggcatccttccgatgctgacttctcaccgtccgttttccaataggagcgggcggtatgtttt

SEQ ID NO: 6585 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acagataccgtgattttttcaagttgagaatcgaaagattcttaataaggcatccttccgatgctgacttctcaccgtccgttttccaataggagcgggcggtatgtttt

SEQ ID NO: 6586 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
actgctgacatatgactcactagttgagaatcgaaagattcttaataaggcatccttccgatgctgacttctcaccgtccgttttccaataggagcgggcggtatgtttt

SEQ ID NO: 6587 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
catatgtcagcagtttgactgtgttgagaatcgaaagattcttaataaggcatccttccgatgctgacttctcaccgtccgttttccaataggagcgggcggtatgtttt

SEQ ID NO: 6588 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tatcagtgagtttttcttttaagttgagaatcgaaagattcttaataaggcatccttccgatgctgacttctcaccgtccgttttccaataggagcgggcggtatgtttt

SEQ ID NO: 6589 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcttatttttctacatgctcttgttgagaatcgaaagattcttaataaggcatccttccgatgctgacttctcaccgtccgttttccaataggagcgggcggtatgtttt

SEQ ID NO: 6590 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttaaatgtcaacctactgtggcgttgagaatcgaaagattcttaataaggcatccttccgatgctgacttctcaccgtccgttttccaataggagcgggcggtatgtttt

SEQ ID NO: 6591 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gaggattaaagtctatgccacagttgagaatcgaaagattcttaataaggcatccttccgatgctgacttctcaccgtccgttttccaataggagcgggcggtatgtttt

SEQ ID NO: 6592 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aagaacaacaaaagaatacccagttgagaatcgaaagattcttaataaggcatccttccgatgctgacttctcaccgtccgttttccaataggagcgggcggtatgtttt

SEQ ID NO: 6593 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tggtatatgctgtggaattgaggttgagaatcgaaagattcttaataaggcatccttccgatgctgacttctcaccgtccgttttccaataggagcgggcggtatgtttt

SEQ ID NO: 6594 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gagatagactggttcgtgagcggttgagaatcgaaagattcttaataaggcatccttccgatgctgacttctcaccgtccgttttccaataggagcgggcggtatgtttt

SEQ ID NO: 6595 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtaggacatgctcaaacaatacgttgagaatcgaaagattcttaataaggcatccttccgatgctgacttctcaccgtccgttttccaataggagcgggcggtatgtttt

SEQ ID NO: 6596 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
attaagcagctgctcactacaagttgagaatcgaaagattcttaataaggcatccttccgatgctgacttctcaccgtccgttttccaataggagcgggcggtatgtttt

SEQ ID NO: 6597 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gagatggagctttattaaacatgttgagaatcgaaagattcttaataaggcatccttccgatgctgacttctcaccgtccgttttccaataggagcgggcggtatgtttt

SEQ ID NO: 6598 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2' O-methyladenosine
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gaactcagcacttcatatgcctgttgagaatcgaaagattcttaataaggcatccttccgatgctgacttctcaccgtccgttttccaataggagcgggcggtatgtttt

SEQ ID NO: 6599 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgagttctcttgaactcctaatgttgagaatcgaaagattcttaataaggcatccttccgatgctgacttctcaccgtccgttttccaataggagcgggcggtatgtttt

SEQ ID NO: 6600 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
attcctgagttcaggtagggaggttgagaatcgaaagattcttaataaggcatccttccgatgctgacttctcaccgtccgttttccaataggagcgggcggtatgtttt

SEQ ID NO: 6601 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tatatatgtttaaagagctggagttgagaatcgaaagattcttaataaggcatccttccgatgctgacttctcaccgtccgttttccaataggagcgggcggtatgtttt

SEQ ID NO: 6602 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggtatgaaagcataagttttctgttgagaatcgaaagattcttaataaggcatccttccgatgctgacttctcaccgtccgttttccaataggagcgggcggtatgtttt

SEQ ID NO: 6603 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgagactgcctttaacatctgtgttgagaatcgaaagattcttaataaggcatccttccgatgctgacttctcaccgtccgttttccaataggagcgggcggtatgtttt

SEQ ID NO: 6604 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aatatttttcaacaggcagcatgttgagaatcgaaagattcttaataaggcatccttccgatgctgacttctcaccgtccgttttccaataggagcgggcggtatgtttt

SEQ ID NO: 6605 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctcccacacccttttatagtttgttgagaatcgaaagattcttaataaggcatccttccgatgctgacttctcaccgtccgttttccaataggagcgggcggtatgtttt

SEQ ID NO: 6606 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = um
  modified_base 1^2: mod_base = OTHER; note = phosphorothioate bond
  modified_base 2^3: mod_base = OTHER; mod_base = OTHER; note = phosphorothioate bond; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; mod_base = OTHER; note = phosphorothioate bond; note = phosphorothioate bond
tatagtttagggattgtatttcgttgagaatcgaaagattcttaataaggcatccttccgatgctgacttctcaccgtccgttttccaataggagcgggcggtatgtttt

SEQ ID NO: 6607 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agggattgtatttccaaggtttgttgagaatcgaaagattcttaataaggcatccttccgatgctgacttctcaccgtccgttttccaataggagcgggcggtatgtttt

SEQ ID NO: 6608 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = gm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agtgtcaatgagcaaagatgaagttgagaatcgaaagattcttaataaggcatccttccgatgctgacttctcaccgtccgttttccaataggagcgggcggtatgtttt

SEQ ID NO: 6609 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2' O-methyladenosine
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccattgaaggggagctaataaggttgagaatcgaaagattcttaataaggcatccttccgatgctgacttctcaccgtccgttttccaataggagcgggcggtatgtttt

SEQ ID NO: 6610 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tggacacatgggtagtcagggtgttgagaatcgaaagattcttaataaggcatccttccgatgctgacttctcaccgtccgttttccaataggagcgggcggtatgtttt

SEQ ID NO: 6611 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cctggaacctgaaggacagttcgttgagaatcgaaagattcttaataaggcatccttccgatgctgacttctcaccgtccgttttccaataggagcgggcggtatgtttt

SEQ ID NO: 6612 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtgcaggtctcagaactgtcctgttgagaatcgaaagattcttaataaggcatccttccgatgctgacttctcaccgtccgttttccaataggagcgggcggtatgtttt

SEQ ID NO: 6613 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2' O-methyladenosine
  modified_base 2: mod_base = um
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atgaaatggagagctaaattatgttgagaatcgaaagattcttaataaggcatccttccgatgctgacttctcaccgtccgttttccaataggagcgggcggtatgtttt

SEQ ID NO: 6614 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = cm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtcacttttaacacacccaagggttgagaatcgaaagattcttaataaggcatccttccgatgctgacttctcaccgtccgttttccaataggagcgggcggtatgtttt

SEQ ID NO: 6615 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2' O-methyladenosine
  modified_base 3: mod_base = gm
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108: mod_base = um
  modified_base 109: mod_base = um
  modified_base 110: mod_base = um
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tagagaggcacatttgccagtagttgagaatcgaaagattcttaataaggcatccttccgatgctgacttctcaccgtccgttttccaataggagcgggcggtatgtttt

SEQ ID NO: 6616 - DNA, 22 bp, unidentified
  misc_feature 1..22: note = Description of Unknown:MG3-6-HPRT-target site-A1 sequence
  source 1..22: mol_type = other DNA
ttcctctgcatcagttttaatg

SEQ ID NO: 6617 - DNA, 22 bp, unidentified
  misc_feature 1..22: note = Description of Unknown:MG3-6-HPRT-target site-B1 sequence
  source 1..22: mol_type = other DNA
gtgggcttgtgttctaaaggag

SEQ ID NO: 6618 - DNA, 22 bp, unidentified
  misc_feature 1..22: note = Description of Unknown:MG3-6-HPRT-target site-C1 sequence
  source 1..22: mol_type = other DNA
aggagtgagattggttttttgt

SEQ ID NO: 6619 - DNA, 22 bp, unidentified
  misc_feature 1..22: note = Description of Unknown:MG3-6-HPRT-target site-D1 sequence
  source 1..22: mol_type = other DNA
taaaaaataatatttataattt

SEQ ID NO: 6620 - DNA, 22 bp, unidentified
  misc_feature 1..22: note = Description of Unknown:MG3-6-HPRT-target site-E1 sequence
  source 1..22: mol_type = other DNA
gagtatttttattgaaaagcat

SEQ ID NO: 6621 - DNA, 22 bp, unidentified
  misc_feature 1..22: note = Description of Unknown:MG3-6-HPRT-target site-F1 sequence
  source 1..22: mol_type = other DNA
aaaaatattttccctaacaaag

SEQ ID NO: 6622 - DNA, 22 bp, unidentified
  misc_feature 1..22: note = Description of Unknown:MG3-6-HPRT-target site-G1 sequence
  source 1..22: mol_type = other DNA
atctcagctatttagtcaaaag

SEQ ID NO: 6623 - DNA, 22 bp, unidentified
  misc_feature 1..22: note = Description of Unknown:MG3-6-HPRT-target site-H1 sequence
  source 1..22: mol_type = other DNA
gtcctacttttgactaaatagc

SEQ ID NO: 6624 - DNA, 22 bp, unidentified
  misc_feature 1..22: note = Description of Unknown:MG3-6-HPRT-target site-A2 sequence
  source 1..22: mol_type = other DNA
aactctccaatataggtggcta

SEQ ID NO: 6625 - DNA, 22 bp, unidentified
  misc_feature 1..22: note = Description of Unknown:MG3-6-HPRT-target site-B2 sequence
  source 1..22: mol_type = other DNA
atttttcccataaattcaagat

SEQ ID NO: 6626 - DNA, 22 bp, unidentified
  misc_feature 1..22: note = Description of Unknown:MG3-6-HPRT-target site-C2 sequence
  source 1..22: mol_type = other DNA
ccaggactggattttgtaggtg

SEQ ID NO: 6627 - DNA, 22 bp, unidentified
  misc_feature 1..22: note = Description of Unknown:MG3-6-HPRT-target site-D2 sequence
  source 1..22: mol_type = other DNA
tgcacctacaaaatccagtcct

SEQ ID NO: 6628 - DNA, 22 bp, unidentified
  misc_feature 1..22: note = Description of Unknown:MG3-6-HPRT-target site-E2 sequence
  source 1..22: mol_type = other DNA
gtaagaatgccagcccccagga

SEQ ID NO: 6629 - DNA, 22 bp, unidentified
  misc_feature 1..22: note = Description of Unknown:MG3-6-HPRT-target site-F2 sequence
  source 1..22: mol_type = other DNA
aagcagtaagaatgccagcccc

SEQ ID NO: 6630 - DNA, 22 bp, unidentified
  misc_feature 1..22: note = Description of Unknown:MG3-6-HPRT-target site-G2 sequence
  source 1..22: mol_type = other DNA
gctggcattcttactgcttgct

SEQ ID NO: 6631 - DNA, 22 bp, unidentified
  misc_feature 1..22: note = Description of Unknown:MG3-6-HPRT-target site-H2 sequence
  source 1..22: mol_type = other DNA
tgcttgctgagggccagatgat

SEQ ID NO: 6632 - DNA, 22 bp, unidentified
  misc_feature 1..22: note = Description of Unknown:MG3-6-HPRT-target site-A3 sequence
  source 1..22: mol_type = other DNA
atagattccagaatatctccat

SEQ ID NO: 6633 - DNA, 22 bp, unidentified
  misc_feature 1..22: note = Description of Unknown:MG3-6-HPRT-target site-B3 sequence
  source 1..22: mol_type = other DNA
tgacagtattgcagttatacat

SEQ ID NO: 6634 - DNA, 22 bp, unidentified
  misc_feature 1..22: note = Description of Unknown:MG3-6-HPRT-target site-C3 sequence
  source 1..22: mol_type = other DNA
cgaaaagtaatgtaatctcata

SEQ ID NO: 6635 - DNA, 22 bp, unidentified
  misc_feature 1..22: note = Description of Unknown:MG3-6-HPRT-target site-D3 sequence
  source 1..22: mol_type = other DNA
ggattatatcttaagtcttata

SEQ ID NO: 6636 - DNA, 22 bp, unidentified
  misc_feature 1..22: note = Description of Unknown:MG3-6-HPRT-target site-E3 sequence
  source 1..22: mol_type = other DNA
aacacatgacaaaattatttaa

SEQ ID NO: 6637 - DNA, 22 bp, unidentified
  misc_feature 1..22: note = Description of Unknown:MG3-6-HPRT-target site-F3 sequence
  source 1..22: mol_type = other DNA
gtttgtcctgaatagcatggca

SEQ ID NO: 6638 - DNA, 22 bp, unidentified
  misc_feature 1..22: note = Description of Unknown:MG3-6-HPRT-target site-G3 sequence
  source 1..22: mol_type = other DNA
ctgaatagcatggcagaggatt

SEQ ID NO: 6639 - DNA, 22 bp, unidentified
  misc_feature 1..22: note = Description of Unknown:MG3-6-HPRT-target site-H3 sequence
  source 1..22: mol_type = other DNA
atccttattcttaattttgcaa

SEQ ID NO: 6640 - DNA, 22 bp, unidentified
  misc_feature 1..22: note = Description of Unknown:MG3-6-HPRT-target site-A4 sequence
  source 1..22: mol_type = other DNA
gcccccttgcaaaattaagaat

SEQ ID NO: 6641 - DNA, 22 bp, unidentified
  misc_feature 1..22: note = Description of Unknown:MG3-6-HPRT-target site-B4 sequence
  source 1..22: mol_type = other DNA
ggtgaggaagtgataggaaggg

SEQ ID NO: 6642 - DNA, 22 bp, unidentified
  misc_feature 1..22: note = Description of Unknown:MG3-6-HPRT-target site-C4 sequence
  source 1..22: mol_type = other DNA
gtgataggaaggggtgggccct

SEQ ID NO: 6643 - DNA, 22 bp, unidentified
  misc_feature 1..22: note = Description of Unknown:MG3-6-HPRT-target site-D4 sequence
  source 1..22: mol_type = other DNA
ggaaggggtgggccctgaagat

SEQ ID NO: 6644 - DNA, 22 bp, unidentified
  misc_feature 1..22: note = Description of Unknown:MG3-6-HPRT-target site-E4 sequence
  source 1..22: mol_type = other DNA
aattccaggaggtccagatctt

SEQ ID NO: 6645 - DNA, 22 bp, unidentified
  misc_feature 1..22: note = Description of Unknown:MG3-6-HPRT-target site-F4 sequence
  source 1..22: mol_type = other DNA
tcatcactcaattccaggaggt

SEQ ID NO: 6646 - DNA, 22 bp, unidentified
  misc_feature 1..22: note = Description of Unknown:MG3-6-HPRT-target site-G4 sequence
  source 1..22: mol_type = other DNA
cagcattcatcactcaattcca

SEQ ID NO: 6647 - DNA, 22 bp, unidentified
  misc_feature 1..22: note = Description of Unknown:MG3-6-HPRT-target site-H4 sequence
  source 1..22: mol_type = other DNA
cagcataggtaaggtgaggagg

SEQ ID NO: 6648 - DNA, 22 bp, unidentified
  misc_feature 1..22: note = Description of Unknown:MG3-6-HPRT-target site-A5 sequence
  source 1..22: mol_type = other DNA
acataaaaactgcagactgatc

SEQ ID NO: 6649 - DNA, 22 bp, unidentified
  misc_feature 1..22: note = Description of Unknown:MG3-6-HPRT-target site-B5 sequence
  source 1..22: mol_type = other DNA
acctgacccctacataaaaact

SEQ ID NO: 6650 - DNA, 22 bp, unidentified
  misc_feature 1..22: note = Description of Unknown:MG3-6-HPRT-target site-C5 sequence
  source 1..22: mol_type = other DNA
gatcagtctgcagtttttatgt

SEQ ID NO: 6651 - DNA, 22 bp, unidentified
  misc_feature 1..22: note = Description of Unknown:MG3-6-HPRT-target site-D5 sequence
  source 1..22: mol_type = other DNA
tctgctttttcctaagtgatta

SEQ ID NO: 6652 - DNA, 22 bp, unidentified
  misc_feature 1..22: note = Description of Unknown:MG3-6-HPRT-target site-E5 sequence
  source 1..22: mol_type = other DNA
acagataccgtgattttttcaa

SEQ ID NO: 6653 - DNA, 22 bp, unidentified
  misc_feature 1..22: note = Description of Unknown:MG3-6-HPRT-target site-F5 sequence
  source 1..22: mol_type = other DNA
actgctgacatatgactcacta

SEQ ID NO: 6654 - DNA, 22 bp, unidentified
  misc_feature 1..22: note = Description of Unknown:MG3-6-HPRT-target site-G5 sequence
  source 1..22: mol_type = other DNA
catatgtcagcagtttgactgt

SEQ ID NO: 6655 - DNA, 22 bp, unidentified
  misc_feature 1..22: note = Description of Unknown:MG3-6-HPRT-target site-H5 sequence
  source 1..22: mol_type = other DNA
tatcagtgagtttttcttttaa

SEQ ID NO: 6656 - DNA, 22 bp, unidentified
  misc_feature 1..22: note = Description of Unknown:MG3-6-HPRT-target site-A6 sequence
  source 1..22: mol_type = other DNA
gcttatttttctacatgctctt

SEQ ID NO: 6657 - DNA, 22 bp, unidentified
  misc_feature 1..22: note = Description of Unknown:MG3-6-HPRT-target site-B6 sequence
  source 1..22: mol_type = other DNA
ttaaatgtcaacctactgtggc

SEQ ID NO: 6658 - DNA, 22 bp, unidentified
  misc_feature 1..22: note = Description of Unknown:MG3-6-HPRT-target site-C6 sequence
  source 1..22: mol_type = other DNA
gaggattaaagtctatgccaca

SEQ ID NO: 6659 - DNA, 22 bp, unidentified
  misc_feature 1..22: note = Description of Unknown:MG3-6-HPRT-target site-D6 sequence
  source 1..22: mol_type = other DNA
aagaacaacaaaagaataccca

SEQ ID NO: 6660 - DNA, 22 bp, unidentified
  misc_feature 1..22: note = Description of Unknown:MG3-6-HPRT-target site-E6 sequence
  source 1..22: mol_type = other DNA
tggtatatgctgtggaattgag

SEQ ID NO: 6661 - DNA, 22 bp, unidentified
  misc_feature 1..22: note = Description of Unknown:MG3-6-HPRT-target site-F6 sequence
  source 1..22: mol_type = other DNA
gagatagactggttcgtgagcg

SEQ ID NO: 6662 - DNA, 22 bp, unidentified
  misc_feature 1..22: note = Description of Unknown:MG3-6-HPRT-target site-G6 sequence
  source 1..22: mol_type = other DNA
gtaggacatgctcaaacaatac

SEQ ID NO: 6663 - DNA, 22 bp, unidentified
  misc_feature 1..22: note = Description of Unknown:MG3-6-HPRT-target site-H6 sequence
  source 1..22: mol_type = other DNA
attaagcagctgctcactacaa

SEQ ID NO: 6664 - DNA, 22 bp, unidentified
  misc_feature 1..22: note = Description of Unknown:MG3-6-HPRT-target site-A7 sequence
  source 1..22: mol_type = other DNA
gagatggagctttattaaacat

SEQ ID NO: 6665 - DNA, 22 bp, unidentified
  misc_feature 1..22: note = Description of Unknown:MG3-6-HPRT-target site-B7 sequence
  source 1..22: mol_type = other DNA
gaactcagcacttcatatgcct

SEQ ID NO: 6666 - DNA, 22 bp, unidentified
  misc_feature 1..22: note = Description of Unknown:MG3-6-HPRT-target site-C7 sequence
  source 1..22: mol_type = other DNA
tgagttctcttgaactcctaat

SEQ ID NO: 6667 - DNA, 22 bp, unidentified
  misc_feature 1..22: note = Description of Unknown:MG3-6-HPRT-target site-D7 sequence
  source 1..22: mol_type = other DNA
attcctgagttcaggtagggag

SEQ ID NO: 6668 - DNA, 22 bp, unidentified
  misc_feature 1..22: note = Description of Unknown:MG3-6-HPRT-target site-E7 sequence
  source 1..22: mol_type = other DNA
tatatatgtttaaagagctgga

SEQ ID NO: 6669 - DNA, 22 bp, unidentified
  misc_feature 1..22: note = Description of Unknown:MG3-6-HPRT-target site-F7 sequence
  source 1..22: mol_type = other DNA
ggtatgaaagcataagttttct

SEQ ID NO: 6670 - DNA, 22 bp, unidentified
  misc_feature 1..22: note = Description of Unknown:MG3-6-HPRT-target site-G7 sequence
  source 1..22: mol_type = other DNA
tgagactgcctttaacatctgt

SEQ ID NO: 6671 - DNA, 22 bp, unidentified
  misc_feature 1..22: note = Description of Unknown:MG3-6-HPRT-target site-H7 sequence
  source 1..22: mol_type = other DNA
aatatttttcaacaggcagcat

SEQ ID NO: 6672 - DNA, 22 bp, unidentified
  misc_feature 1..22: note = Description of Unknown:MG3-6-HPRT-target site-A8 sequence
  source 1..22: mol_type = other DNA
ctcccacacccttttatagttt

SEQ ID NO: 6673 - DNA, 22 bp, unidentified
  misc_feature 1..22: note = Description of Unknown:MG3-6-HPRT-target site-B8 sequence
  source 1..22: mol_type = other DNA
tatagtttagggattgtatttc

SEQ ID NO: 6674 - DNA, 22 bp, unidentified
  misc_feature 1..22: note = Description of Unknown:MG3-6-HPRT-target site-C8 sequence
  source 1..22: mol_type = other DNA
agggattgtatttccaaggttt

SEQ ID NO: 6675 - DNA, 22 bp, unidentified
  misc_feature 1..22: note = Description of Unknown:MG3-6-HPRT-target site-D8 sequence
  source 1..22: mol_type = other DNA
agtgtcaatgagcaaagatgaa

SEQ ID NO: 6676 - DNA, 22 bp, unidentified
  misc_feature 1..22: note = Description of Unknown:MG3-6-HPRT-target site-E8 sequence
  source 1..22: mol_type = other DNA
ccattgaaggggagctaataag

SEQ ID NO: 6677 - DNA, 22 bp, unidentified
  misc_feature 1..22: note = Description of Unknown:MG3-6-HPRT-target site-F8 sequence
  source 1..22: mol_type = other DNA
tggacacatgggtagtcagggt

SEQ ID NO: 6678 - DNA, 22 bp, unidentified
  misc_feature 1..22: note = Description of Unknown:MG3-6-HPRT-target site-G8 sequence
  source 1..22: mol_type = other DNA
cctggaacctgaaggacagttc

SEQ ID NO: 6679 - DNA, 22 bp, unidentified
  misc_feature 1..22: note = Description of Unknown:MG3-6-HPRT-target site-H8 sequence
  source 1..22: mol_type = other DNA
gtgcaggtctcagaactgtcct

SEQ ID NO: 6680 - DNA, 22 bp, unidentified
  misc_feature 1..22: note = Description of Unknown:MG3-6-HPRT-target site-A9 sequence
  source 1..22: mol_type = other DNA
atgaaatggagagctaaattat

SEQ ID NO: 6681 - DNA, 22 bp, unidentified
  misc_feature 1..22: note = Description of Unknown:MG3-6-HPRT-target site-B9 sequence
  source 1..22: mol_type = other DNA
gtcacttttaacacacccaagg

SEQ ID NO: 6682 - DNA, 22 bp, unidentified
  misc_feature 1..22: note = Description of Unknown:MG3-6-HPRT-target site-C9 sequence
  source 1..22: mol_type = other DNA
tagagaggcacatttgccagta

SEQ ID NO: 6683 - RNA, 108 nt, synthetic construct
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = gm
  modified_base 3: mod_base = gm
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 106: mod_base = um
  modified_base 107: mod_base = um
  modified_base 108: mod_base = um
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
aggtcctctggaaagggaaggttgagaatcgaaagattcttaataaggcatccttccgatgctgacttctcaccgtccgttttccaataggagcgggcggtatgtttt

SEQ ID NO: 6684 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = OTHER; note = 2-O-methyladenosine
  modified_base 3: mod_base = gm
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 106: mod_base = um
  modified_base 107: mod_base = um
  modified_base 108: mod_base = um
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
caggtcctctggaaagggaagttgagaatcgaaagattcttaataaggcatccttccgatgctgacttctcaccgtccgttttccaataggagcgggcggtatgtttt

SEQ ID NO: 6685 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = cm
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
ccacactggtgtgcctggccgttgagaatcgaaagattcttaataaggcatccttccgatgctgacttctcaccgtccgttttccaataggagcgggcggtatgtttt

SEQ ID NO: 6686 - RNA, 108 nt, synthetic construct
  misc_feature 1..108: note = Description of Artificial Sequence: Syntheticpolynucleotide
  source 1..108: mol_type = other RNA
  modified_base 1: mod_base = gm
  modified_base 2: mod_base = OTHER; note = 2-O-methyladenosine
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
gaatgggaaggaggtgcacagttgagaatcgaaagattcttaataaggcatccttccgatgctgacttctcaccgtccgttttccaataggagcgggcggtatgtttt

SEQ ID NO: 6687 - RNA, 108 nt, synthetic construct
  misc_feature 1..108: note = Description of Artificial Sequence: Syntheticpolynucleotide
  source 1..108: mol_type = other RNA
  modified_base 1: mod_base = um
  modified_base 2: mod_base = gm
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
tgagggcgggctgctccttggttgagaatcgaaagattcttaataaggcatccttccgatgctgacttctcaccgtccgttttccaataggagcgggcggtatgtttt

SEQ ID NO: 6688 - RNA, 108 nt, synthetic construct
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = gm
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
agtatctggagtcattgagggttgagaatcgaaagattcttaataaggcatccttccgatgctgacttctcaccgtccgttttccaataggagcgggcggtatgtttt

SEQ ID NO: 6689 - RNA, 108 nt, synthetic construct
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = um
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
atactgcctgagcagccgccgttgagaatcgaaagattcttaataaggcatccttccgatgctgacttctcaccgtccgttttccaataggagcgggcggtatgtttt

SEQ ID NO: 6690 - RNA, 108 nt, synthetic construct
  misc_feature 1..108: note = Description of Artificial Sequence: Syntheticpolynucleotide
  source 1..108: mol_type = other RNA
  modified_base 1: mod_base = um
  modified_base 2: mod_base = um
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
ttgacagcggaagtggttgcgttgagaatcgaaagattcttaataaggcatccttccgatgctgacttctcaccgtccgttttccaataggagcgggcggtatgtttt

SEQ ID NO: 6691 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = um
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
cttgacagcggaagtggttggttgagaatcgaaagattcttaataaggcatccttccgatgctgacttctcaccgtccgttttccaataggagcgggcggtatgtttt

SEQ ID NO: 6692 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = cm
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
ccgctgtcaagtccagttctgttgagaatcgaaagattcttaataaggcatccttccgatgctgacttctcaccgtccgttttccaataggagcgggcggtatgtttt

SEQ ID NO: 6693 - RNA, 108 nt, synthetic construct
  misc_feature 1..108: note = Description of Artificial Sequence: Syntheticpolynucleotide
  source 1..108: mol_type = other RNA
  modified_base 1: mod_base = um
  modified_base 2: mod_base = cm
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
tcggagaatgacgagtggacgttgagaatcgaaagattcttaataaggcatccttccgatgctgacttctcaccgtccgttttccaataggagcgggcggtatgtttt

SEQ ID NO: 6694 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = OTHER; note = 2-O-methyladenosine
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
cagatcgtcagcgccgaggcgttgagaatcgaaagattcttaataaggcatccttccgatgctgacttctcaccgtccgttttccaataggagcgggcggtatgtttt

SEQ ID NO: 6695 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = gm
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
cggcgctgacgatctgggtggttgagaatcgaaagattcttaataaggcatccttccgatgctgacttctcaccgtccgttttccaataggagcgggcggtatgtttt

SEQ ID NO: 6696 - RNA, 108 nt, synthetic construct
  misc_feature 1..108: note = Description of Artificial Sequence: Syntheticpolynucleotide
  source 1..108: mol_type = other RNA
  modified_base 1: mod_base = gm
  modified_base 2: mod_base = cm
  modified_base 3: mod_base = cm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
gccaacagtgtcctaccagcgttgagaatcgaaagattcttaataaggcatccttccgatgctgacttctcaccgtccgttttccaataggagcgggcggtatgtttt

SEQ ID NO: 6697 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = um
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
cttccctagcaggatctcatgttgagaatcgaaagattcttaataaggcatccttccgatgctgacttctcaccgtccgttttccaataggagcgggcggtatgtttt

SEQ ID NO: 6698 - RNA, 108 nt, synthetic construct
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = um
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
atacagggtggccttccctagttgagaatcgaaagattcttaataaggcatccttccgatgctgacttctcaccgtccgttttccaataggagcgggcggtatgtttt

SEQ ID NO: 6699 - RNA, 108 nt, synthetic construct
  misc_feature 1..108: note = Description of Artificial Sequence: Syntheticpolynucleotide
  source 1..108: mol_type = other RNA
  modified_base 1: mod_base = gm
  modified_base 2: mod_base = gm
  modified_base 3: mod_base = cm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
ggcgctgaccagcacagcatgttgagaatcgaaagattcttaataaggcatccttccgatgctgacttctcaccgtccgttttccaataggagcgggcggtatgtttt

SEQ ID NO: 6700 - RNA, 108 nt, synthetic construct
  misc_feature 1..108: note = Description of Artificial Sequence: Syntheticpolynucleotide
  source 1..108: mol_type = other RNA
  modified_base 1: mod_base = um
  modified_base 2: mod_base = cm
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
tctcttctgcaggtcaagaggttgagaatcgaaagattcttaataaggcatccttccgatgctgacttctcaccgtccgttttccaataggagcgggcggtatgtttt

SEQ ID NO: 6701 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = cm
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
cctgcagaagagaaagttttgttgagaatcgaaagattcttaataaggcatccttccgatgctgacttctcaccgtccgttttccaataggagcgggcggtatgtttt

SEQ ID NO: 6702 - RNA, 108 nt, synthetic construct
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = cm
  modified_base 3: mod_base = cm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
acctgcagaagagaaagtttgttgagaatcgaaagattcttaataaggcatccttccgatgctgacttctcaccgtccgttttccaataggagcgggcggtatgtttt

SEQ ID NO: 6703 - RNA, 108 nt, synthetic construct; identical to SEQ ID NO: 6685
  misc_feature 1..108: note = Description of Artificial Sequence: Syntheticpolynucleotide
  source 1..108: mol_type = other RNA
  modified_base 1: mod_base = cm
  modified_base 2: mod_base = cm
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6704 - RNA, 108 nt, synthetic construct
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = cm
  modified_base 3: mod_base = cm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
accagctcagctccacgtgggttgagaatcgaaagattcttaataaggcatccttccgatgctgacttctcaccgtccgttttccaataggagcgggcggtatgtttt

SEQ ID NO: 6705 - RNA, 108 nt, synthetic construct; identical to SEQ ID NO: 6686
  misc_feature 1..108: note = Description of Artificial Sequence: Syntheticpolynucleotide
  source 1..108: mol_type = other RNA
  modified_base 1: mod_base = gm
  modified_base 2: mod_base = OTHER; note = 2-O-methyladenosine
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6706 - RNA, 108 nt, synthetic construct; identical to SEQ ID NO: 6687
  misc_feature 1..108: note = Description of Artificial Sequence: Syntheticpolynucleotide
  source 1..108: mol_type = other RNA
  modified_base 1: mod_base = um
  modified_base 2: mod_base = gm
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6707 - RNA, 108 nt, synthetic construct; identical to SEQ ID NO: 6688
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = gm
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6708 - RNA, 108 nt, synthetic construct; identical to SEQ ID NO: 6689
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = um
  modified_base 3: mod_base = OTHER; note = 2-O-methyladenosine
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 107^108: mod_base = OTHER; note = Phosphorothioate bond
  modified_base 107^108: mod_base = OTHER; note = Phosphorothioate bond

SEQ ID NO: 6709 - RNA, 108 nt, synthetic construct; identical to SEQ ID NO: 6690
  misc_feature 1..108: note = Description of Artificial Sequence: Syntheticpolynucleotide
  source 1..108: mol_type = other RNA
  modified_base 1: mod_base = um
  modified_base 2: mod_base = um
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6710 - RNA, 108 nt, synthetic construct; identical to SEQ ID NO: 6691
  misc_feature 1..108: note = Description of Artificial Sequence: Syntheticpolynucleotide
  source 1..108: mol_type = other RNA
  modified_base 1: mod_base = cm
  modified_base 2: mod_base = um
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6711 - RNA, 108 nt, synthetic construct; identical to SEQ ID NO: 6692
  misc_feature 1..108: note = Description of Artificial Sequence: Syntheticpolynucleotide
  source 1..108: mol_type = other RNA
  modified_base 1: mod_base = cm
  modified_base 2: mod_base = cm
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6712 - RNA, 108 nt, synthetic construct; identical to SEQ ID NO: 6693
  misc_feature 1..108: note = Description of Artificial Sequence: Syntheticpolynucleotide
  source 1..108: mol_type = other RNA
  modified_base 1: mod_base = um
  modified_base 2: mod_base = cm
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6713 - RNA, 108 nt, synthetic construct; identical to SEQ ID NO: 6694
  misc_feature 1..108: note = Description of Artificial Sequence: Syntheticpolynucleotide
  source 1..108: mol_type = other RNA
  modified_base 1: mod_base = cm
  modified_base 2: mod_base = OTHER; note = 2-O-methyladenosine
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6714 - RNA, 108 nt, synthetic construct; identical to SEQ ID NO: 6695
  misc_feature 1..108: note = Description of Artificial Sequence: Syntheticpolynucleotide
  source 1..108: mol_type = other RNA
  modified_base 1: mod_base = cm
  modified_base 2: mod_base = gm
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond

SEQ ID NO: 6715 - RNA, 108 nt, synthetic construct
  misc_feature 1..108: note = Description of Artificial Sequence: Syntheticpolynucleotide
  source 1..108: mol_type = other RNA
  modified_base 1: mod_base = gm
  modified_base 2: mod_base = um
  modified_base 3: mod_base = cm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
gtcaacagagtcttaccagcgttgagaatcgaaagattcttaataaggcatccttccgatgctgacttctcaccgtccgttttccaataggagcgggcggtatgtttt

SEQ ID NO: 6716 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = um
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
cttccctagcaagatctcatgttgagaatcgaaagattcttaataaggcatccttccgatgctgacttctcaccgtccgttttccaataggagcgggcggtatgtttt

SEQ ID NO: 6717 - RNA, 108 nt, synthetic construct
  misc_feature 1..108: note = Description of Artificial Sequence: Syntheticpolynucleotide
  source 1..108: mol_type = other RNA
  modified_base 1: mod_base = gm
  modified_base 2: mod_base = cm
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
gctgatggccatggtaaggagttgagaatcgaaagattcttaataaggcatccttccgatgctgacttctcaccgtccgttttccaataggagcgggcggtatgtttt

SEQ ID NO: 6718 - RNA, 108 nt, synthetic construct
  misc_feature 1..108: note = Description of Artificial Sequence: Syntheticpolynucleotide
  source 1..108: mol_type = other RNA
  modified_base 1: mod_base = um
  modified_base 2: mod_base = gm
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
tgtggaagagagaacattttgttgagaatcgaaagattcttaataaggcatccttccgatgctgacttctcaccgtccgttttccaataggagcgggcggtatgtttt

SEQ ID NO: 6719 - RNA, 108 nt, synthetic construct
  misc_feature 1..108: note = Description of Artificial Sequence: Syntheticpolynucleotide
  source 1..108: mol_type = other RNA
  modified_base 1: mod_base = cm
  modified_base 2: mod_base = um
  modified_base 3: mod_base = gm
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
ctgtggaagagagaacatttgttgagaatcgaaagattcttaataaggcatccttccgatgctgacttctcaccgtccgttttccaataggagcgggcggtatgtttt

SEQ ID NO: 6720 - RNA, 108 nt, synthetic construct
  misc_feature 1..108: note = Description of Artificial Sequence: Syntheticpolynucleotide
  source 1..108: mol_type = other RNA
  modified_base 1: mod_base = um
  modified_base 2: mod_base = cm
  modified_base 3: mod_base = um
  modified_base 106: mod_base = um
  modified_base 107: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
tctcttccacaggtcaagaggttgagaatcgaaagattcttaataaggcatccttccgatgctgacttctcaccgtccgttttccaataggagcgggcggtatgtttt

SEQ ID NO: 6721 - RNA, 108 nt, synthetic construct
  misc_feature 1..108: note = Description of Artificial Sequence: Syntheticpolynucleotide
  source 1..108: mol_type = other RNA
  modified_base 1: mod_base = OTHER; note = 2-O-methyladenosine
  modified_base 2: mod_base = gm
  modified_base 3: mod_base = gm
  modified_base 106: mod_base = um
  modified_base 106: mod_base = um
  modified_base 108: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 105^106: mod_base = OTHER; note = Phosphorothioate bond
  modified_base 106^107: mod_base = OTHER; note = Phosphorothioate bond
  modified_base 107^108: mod_base = OTHER; note = Phosphorothioate bond
aggtcaagagaaaggattccgttgagaatcgaaagattcttaataaggcatccttccgatgctgacttctcaccgtccgttttccaataggagcgggcggtatgtttt

SEQ ID NO: 6722 - DNA, 20 bp, unidentified
  misc_feature 1..20: note = Description of Unknown:MG3-6-TRBC1/2-target site-A6 sequence
  source 1..20: mol_type = other DNA
aggtcctctggaaagggaag

SEQ ID NO: 6723 - DNA, 20 bp, unidentified
  misc_feature 1..20: note = Description of Unknown:MG3-6-TRBC1/2-target site-B6 sequence
  source 1..20: mol_type = other DNA
caggtcctctggaaagggaa

SEQ ID NO: 6724 - DNA, 20 bp, unidentified
  misc_feature 1..20: note = Description of Unknown:MG3-6-TRBC1/2-target site-C6 sequence
  source 1..20: mol_type = other DNA
ccacactggtgtgcctggcc

SEQ ID NO: 6725 - DNA, 20 bp, unidentified
  misc_feature 1..20: note = Description of Unknown:MG3-6-TRBC1/2-target site-D6 sequence
  source 1..20: mol_type = other DNA
gaatgggaaggaggtgcaca

SEQ ID NO: 6726 - DNA, 20 bp, unidentified
  misc_feature 1..20: note = Description of Unknown:MG3-6-TRBC1/2-target site-E6 sequence
  source 1..20: mol_type = other DNA
tgagggcgggctgctccttg

SEQ ID NO: 6727 - DNA, 20 bp, unidentified
  misc_feature 1..20: note = Description of Unknown:MG3-6-TRBC1/2-target site-F6 sequence
  source 1..20: mol_type = other DNA
agtatctggagtcattgagg

SEQ ID NO: 6728 - DNA, 20 bp, unidentified
  misc_feature 1..20: note = Description of Unknown:MG3-6-TRBC1/2-target site-G6 sequence
  source 1..20: mol_type = other DNA
atactgcctgagcagccgcc

SEQ ID NO: 6729 - DNA, 20 bp, unidentified
  misc_feature 1..20: note = Description of Unknown:MG3-6-TRBC1/2-target site-H6 sequence
  source 1..20: mol_type = other DNA
ttgacagcggaagtggttgc

SEQ ID NO: 6730 - DNA, 20 bp, unidentified
  misc_feature 1..20: note = Description of Unknown:MG3-6-TRBC1/2-target site-A7 sequence
  source 1..20: mol_type = other DNA
cttgacagcggaagtggttg

SEQ ID NO: 6731 - DNA, 20 bp, unidentified
  misc_feature 1..20: note = Description of Unknown:MG3-6-TRBC1/2-target site-B7 sequence
  source 1..20: mol_type = other DNA
ccgctgtcaagtccagttct

SEQ ID NO: 6732 - DNA, 20 bp, unidentified
  misc_feature 1..20: note = Description of Unknown:MG3-6-TRBC1/2-target site-C7 sequence
  source 1..20: mol_type = other DNA
tcggagaatgacgagtggac

SEQ ID NO: 6733 - DNA, 20 bp, unidentified
  misc_feature 1..20: note = Description of Unknown:MG3-6-TRBC1/2-target site-D7 sequence
  source 1..20: mol_type = other DNA
cagatcgtcagcgccgaggc

SEQ ID NO: 6734 - DNA, 20 bp, unidentified
  misc_feature 1..20: note = Description of Unknown:MG3-6-TRBC1/2-target site-E7 sequence
  source 1..20: mol_type = other DNA
cggcgctgacgatctgggtg

SEQ ID NO: 6735 - DNA, 20 bp, unidentified
  misc_feature 1..20: note = Description of Unknown:MG3-6-TRBC1/2-target site-F7 sequence
  source 1..20: mol_type = other DNA
gccaacagtgtcctaccagc

SEQ ID NO: 6736 - DNA, 20 bp, unidentified
  misc_feature 1..20: note = Description of Unknown:MG3-6-TRBC1/2-target site-G7 sequence
  source 1..20: mol_type = other DNA
cttccctagcaggatctcat

SEQ ID NO: 6737 - DNA, 20 bp, unidentified
  misc_feature 1..20: note = Description of Unknown:MG3-6-TRBC1/2-target site-H7 sequence
  source 1..20: mol_type = other DNA
atacagggtggccttcccta

SEQ ID NO: 6738 - DNA, 20 bp, unidentified
  misc_feature 1..20: note = Description of Unknown:MG3-6-TRBC1/2-target site-A8 sequence
  source 1..20: mol_type = other DNA
ggcgctgaccagcacagcat

SEQ ID NO: 6739 - DNA, 20 bp, unidentified
  misc_feature 1..20: note = Description of Unknown:MG3-6-TRBC1/2-target site-B8 sequence
  source 1..20: mol_type = other DNA
tctcttctgcaggtcaagag

SEQ ID NO: 6740 - DNA, 20 bp, unidentified
  misc_feature 1..20: note = Description of Unknown:MG3-6-TRBC1/2-target site-C8 sequence
  source 1..20: mol_type = other DNA
cctgcagaagagaaagtttt

SEQ ID NO: 6741 - DNA, 20 bp, unidentified
  misc_feature 1..20: note = Description of Unknown:MG3-6-TRBC1/2-target site-D8 sequence
  source 1..20: mol_type = other DNA
acctgcagaagagaaagttt

SEQ ID NO: 6742 - DNA, 20 bp, unidentified
  misc_feature 1..20: note = Description of Unknown:MG3-6-TRBC1/2-target site-E8 sequence
  source 1..20: mol_type = other DNA
ccacactggtgtgcctggcc

SEQ ID NO: 6743 - DNA, 20 bp, unidentified
  misc_feature 1..20: note = Description of Unknown:MG3-6-TRBC1/2-target site-F8 sequence
  source 1..20: mol_type = other DNA
accagctcagctccacgtgg

SEQ ID NO: 6744 - DNA, 20 bp, unidentified
  misc_feature 1..20: note = Description of Unknown:MG3-6-TRBC1/2-target site-G8 sequence
  source 1..20: mol_type = other DNA
gaatgggaaggaggtgcaca

SEQ ID NO: 6745 - DNA, 20 bp, unidentified
  misc_feature 1..20: note = Description of Unknown:MG3-6-TRBC1/2-target site-H8 sequence
  source 1..20: mol_type = other DNA
tgagggcgggctgctccttg

SEQ ID NO: 6746 - DNA, 20 bp, unidentified
  misc_feature 1..20: note = Description of Unknown:MG3-6-TRBC1/2-target site-A9 sequence
  source 1..20: mol_type = other DNA
agtatctggagtcattgagg

SEQ ID NO: 6747 - DNA, 20 bp, unidentified
  misc_feature 1..20: note = Description of Unknown:MG3-6-TRBC1/2-target site-B9 sequence
  source 1..20: mol_type = other DNA
atactgcctgagcagccgcc

SEQ ID NO: 6748 - DNA, 20 bp, unidentified
  misc_feature 1..20: note = Description of Unknown:MG3-6-TRBC1/2-target site-C9 sequence
  source 1..20: mol_type = other DNA
ttgacagcggaagtggttgc

SEQ ID NO: 6749 - DNA, 20 bp, unidentified
  misc_feature 1..20: note = Description of Unknown:MG3-6-TRBC1/2-target site-D9 sequence
  source 1..20: mol_type = other DNA
cttgacagcggaagtggttg

SEQ ID NO: 6750 - DNA, 20 bp, unidentified
  misc_feature 1..20: note = Description of Unknown:MG3-6-TRBC1/2-target site-E9 sequence
  source 1..20: mol_type = other DNA
ccgctgtcaagtccagttct

SEQ ID NO: 6751 - DNA, 20 bp, unidentified
  misc_feature 1..20: note = Description of Unknown:MG3-6-TRBC1/2-target site-F9 sequence
  source 1..20: mol_type = other DNA
tcggagaatgacgagtggac

SEQ ID NO: 6752 - DNA, 20 bp, unidentified
  misc_feature 1..20: note = Description of Unknown:MG3-6-TRBC1/2-target site-G9 sequence
  source 1..20: mol_type = other DNA
cagatcgtcagcgccgaggc

SEQ ID NO: 6753 - DNA, 20 bp, unidentified
  misc_feature 1..20: note = Description of Unknown:MG3-6-TRBC1/2-target site-H9 sequence
  source 1..20: mol_type = other DNA
cggcgctgacgatctgggtg

SEQ ID NO: 6754 - DNA, 20 bp, unidentified
  misc_feature 1..20: note = Description of Unknown:MG3-6-TRBC1/2-target site-A10 sequence
  source 1..20: mol_type = other DNA
gtcaacagagtcttaccagc

SEQ ID NO: 6755 - DNA, 20 bp, unidentified
  misc_feature 1..20: note = Description of Unknown:MG3-6-TRBC1/2-target site-B10 sequence
  source 1..20: mol_type = other DNA
cttccctagcaagatctcat

SEQ ID NO: 6756 - DNA, 20 bp, unidentified
  misc_feature 1..20: note = Description of Unknown:MG3-6-TRBC1/2-target site-C10 sequence
  source 1..20: mol_type = other DNA
gctgatggccatggtaagga

SEQ ID NO: 6757 - DNA, 20 bp, unidentified
  misc_feature 1..20: note = Description of Unknown:MG3-6-TRBC1/2-target site-D10 sequence
  source 1..20: mol_type = other DNA
tgtggaagagagaacatttt

SEQ ID NO: 6758 - DNA, 20 bp, unidentified
  misc_feature 1..20: note = Description of Unknown:MG3-6-TRBC1/2-target site-E10 sequence
  source 1..20: mol_type = other DNA
ctgtggaagagagaacattt

SEQ ID NO: 6759 - DNA, 20 bp, unidentified
  misc_feature 1..20: note = Description of Unknown:MG3-6-TRBC1/2-target site-F10 sequence
  source 1..20: mol_type = other DNA
tctcttccacaggtcaagag

SEQ ID NO: 6760 - DNA, 20 bp, unidentified
  misc_feature 1..20: note = Description of Unknown:MG3-6-TRBC1/2-target site-G10 sequence
  source 1..20: mol_type = other DNA
aggtcaagagaaaggattcc

SEQ ID NO: 6761 - RNA, 116 nt, synthetic construct
  misc_feature 1..116: note = Description of Artificial Sequence: Syntheticpolynucleotide
  source 1..116: mol_type = other RNA
  modified_base 1: mod_base = OTHER; note = 2-O-methyladenosine
  modified_base 2: mod_base = gm
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
aggtcctctggaaagggaaggttgagaatctttcgaaagaaagattcttaataaggcatccttccgatgctgacttctcaccgtccggctcctcttaggaacgggcggtatgtttt

SEQ ID NO: 6762 - RNA, 116 nt, synthetic construct
  misc_feature 1..116: note = Description of Artificial Sequence: Syntheticpolynucleotide
  source 1..116: mol_type = other RNA
  modified_base 1: mod_base = cm
  modified_base 2: mod_base = um
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
ctgaacaaggtgttcccaccgttgagaatctttcgaaagaaagattcttaataaggcatccttccgatgctgacttctcaccgtccggctcctcttaggaacgggcggtatgtttt

SEQ ID NO: 6763 - RNA, 116 nt, synthetic construct
  misc_feature 1..116: note = Description of Artificial Sequence: Syntheticpolynucleotide
  source 1..116: mol_type = other RNA
  modified_base 1: mod_base = cm
  modified_base 2: mod_base = um
  modified_base 3: mod_base = cm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
ctcgggtgggaacaccttgtgttgagaatctttcgaaagaaagattcttaataaggcatccttccgatgctgacttctcaccgtccggctcctcttaggaacgggcggtatgtttt

SEQ ID NO: 6764 - RNA, 116 nt, synthetic construct
  misc_feature 1..116: note = Description of Artificial Sequence: Syntheticpolynucleotide
  source 1..116: mol_type = other RNA
  modified_base 1: mod_base = OTHER; note = 2-O-methyladenosine
  modified_base 2: mod_base = OTHER; note = 2-O-methyladenosine
  modified_base 3: mod_base = um
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
aatgggaaggaggtgcacaggttgagaatctttcgaaagaaagattcttaataaggcatccttccgatgctgacttctcaccgtccggctcctcttaggaacgggcggtatgtttt

SEQ ID NO: 6765 - RNA, 116 nt, synthetic construct
  misc_feature 1..116: note = Description of Artificial Sequence: Syntheticpolynucleotide
  source 1..116: mol_type = other RNA
  modified_base 1: mod_base = gm
  modified_base 2: mod_base = gm
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
gggctgctccttgaggggctgttgagaatctttcgaaagaaagattcttaataaggcatccttccgatgctgacttctcaccgtccggctcctcttaggaacgggcggtatgtttt

SEQ ID NO: 6766 - RNA, 116 nt, synthetic construct
  misc_feature 1..116: note = Description of Artificial Sequence: Syntheticpolynucleotide
  source 1..116: mol_type = other RNA
  modified_base 1: mod_base = um
  modified_base 2: mod_base = OTHER; note = 2-O-methyladenosine
  modified_base 3: mod_base = cm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
tactgcctgagcagccgcctgttgagaatctttcgaaagaaagattcttaataaggcatccttccgatgctgacttctcaccgtccggctcctcttaggaacgggcggtatgtttt

SEQ ID NO: 6767 - RNA, 116 nt, synthetic construct
  misc_feature 1..116: note = Description of Artificial Sequence: Syntheticpolynucleotide
  source 1..116: mol_type = other RNA
  modified_base 1: mod_base = um
  modified_base 2: mod_base = um
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
ttgacagcggaagtggttgcgttgagaatctttcgaaagaaagattcttaataaggcatccttccgatgctgacttctcaccgtccggctcctcttaggaacgggcggtatgtttt

SEQ ID NO: 6768 - RNA, 116 nt, synthetic construct
  misc_feature 1..116: note = Description of Artificial Sequence: Syntheticpolynucleotide
  source 1..116: mol_type = other RNA
  modified_base 1: mod_base = gm
  modified_base 2: mod_base = um
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
gtgacgggtttggccctatcgttgagaatctttcgaaagaaagattcttaataaggcatccttccgatgctgacttctcaccgtccggctcctcttaggaacgggcggtatgtttt

SEQ ID NO: 6769 - RNA, 116 nt, synthetic construct
  misc_feature 1..116: note = Description of Artificial Sequence: Syntheticpolynucleotide
  source 1..116: mol_type = other RNA
  modified_base 1: mod_base = cm
  modified_base 2: mod_base = gm
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
cggcgctgacgatctgggtggttgagaatctttcgaaagaaagattcttaataaggcatccttccgatgctgacttctcaccgtccggctcctcttaggaacgggcggtatgtttt

SEQ ID NO: 6770 - RNA, 116 nt, synthetic construct
  misc_feature 1..116: note = Description of Artificial Sequence: Syntheticpolynucleotide
  source 1..116: mol_type = other RNA
  modified_base 1: mod_base = cm
  modified_base 2: mod_base = cm
  modified_base 3: mod_base = OTHER; note = 2-O-methyladenosine
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
ccaacagtgtcctaccagcagttgagaatctttcgaaagaaagattcttaataaggcatccttccgatgctgacttctcaccgtccggctcctcttaggaacgggcggtatgtttt

SEQ ID NO: 6771 - RNA, 116 nt, synthetic construct
  misc_feature 1..116: note = Description of Artificial Sequence: Syntheticpolynucleotide
  source 1..116: mol_type = other RNA
  modified_base 1: mod_base = cm
  modified_base 2: mod_base = cm
  modified_base 3: mod_base = um
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
cctgcagaagagaaagttttgttgagaatctttcgaaagaaagattcttaataaggcatccttccgatgctgacttctcaccgtccggctcctcttaggaacgggcggtatgtttt

SEQ ID NO: 6772 - RNA, 116 nt, synthetic construct
  misc_feature 1..116: note = Description of Artificial Sequence: Syntheticpolynucleotide
  source 1..116: mol_type = other RNA
  modified_base 1: mod_base = cm
  modified_base 2: mod_base = um
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = um
  modified_base 114^115: mod_base = OTHER; note = Phosphorothioate bond
  modified_base 115^116: mod_base = OTHER; note = Phosphorothioate bond
ctgaaaaacgtgttcccaccgttgagaatctttcgaaagaaagattcttaataaggcatccttccgatgctgacttctcaccgtccggctcctcttaggaacgggcggtatgtttt

SEQ ID NO: 6773 - RNA, 116 nt, synthetic construct
  misc_feature 1..116: note = Description of Artificial Sequence: Syntheticpolynucleotide
  source 1..116: mol_type = other RNA
  modified_base 1: mod_base = cm
  modified_base 2: mod_base = um
  modified_base 3: mod_base = um
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
cttgggtgggaacacgttttgttgagaatctttcgaaagaaagattcttaataaggcatccttccgatgctgacttctcaccgtccggctcctcttaggaacgggcggtatgtttt

SEQ ID NO: 6774 - RNA, 116 nt, synthetic construct; identical to SEQ ID NO: 6764
  misc_feature 1..116: note = Description of Artificial Sequence: Syntheticpolynucleotide
  source 1..116: mol_type = other RNA
  modified_base 1: mod_base = OTHER; note = 2-O-methyladenosine
  modified_base 2: mod_base = OTHER; note = 2-O-methyladenosine
  modified_base 3: mod_base = um
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond

SEQ ID NO: 6775 - RNA, 116 nt, synthetic construct; identical to SEQ ID NO: 6765
  misc_feature 1..116: note = Description of Artificial Sequence: Syntheticpolynucleotide
  source 1..116: mol_type = other RNA
  modified_base 1: mod_base = gm
  modified_base 2: mod_base = gm
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond

SEQ ID NO: 6776 - RNA, 116 nt, synthetic construct; identical to SEQ ID NO: 6766
  misc_feature 1..116: note = Description of Artificial Sequence: Syntheticpolynucleotide
  source 1..116: mol_type = other RNA
  modified_base 1: mod_base = um
  modified_base 2: mod_base = OTHER; note = 2-O-methyladenosine
  modified_base 3: mod_base = cm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond

SEQ ID NO: 6777 - RNA, 116 nt, synthetic construct; identical to SEQ ID NO: 6767
  misc_feature 1..116: note = Description of Artificial Sequence: Syntheticpolynucleotide
  source 1..116: mol_type = other RNA
  modified_base 1: mod_base = um
  modified_base 2: mod_base = um
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond

SEQ ID NO: 6778 - RNA, 116 nt, synthetic construct
  misc_feature 1..116: note = Description of Artificial Sequence: Syntheticpolynucleotide
  source 1..116: mol_type = other RNA
  modified_base 1: mod_base = gm
  modified_base 2: mod_base = um
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
gtgacaggtttggccctatcgttgagaatctttcgaaagaaagattcttaataaggcatccttccgatgctgacttctcaccgtccggctcctcttaggaacgggcggtatgtttt

SEQ ID NO: 6779 - RNA, 116 nt, synthetic construct; identical to SEQ ID NO: 6769
  misc_feature 1..116: note = Description of Artificial Sequence: Syntheticpolynucleotide
  source 1..116: mol_type = other RNA
  modified_base 1: mod_base = cm
  modified_base 2: mod_base = gm
  modified_base 3: mod_base = gm
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond

SEQ ID NO: 6780 - RNA, 116 nt, synthetic construct
  misc_feature 1..116: note = Description of Artificial Sequence: Syntheticpolynucleotide
  source 1..116: mol_type = other RNA
  modified_base 1: mod_base = um
  modified_base 2: mod_base = cm
  modified_base 3: mod_base = OTHER; note = 2-O-methyladenosine
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
tcaacagagtcttaccagcagttgagaatctttcgaaagaaagattcttaataaggcatccttccgatgctgacttctcaccgtccggctcctcttaggaacgggcggtatgtttt

SEQ ID NO: 6781 - RNA, 116 nt, synthetic construct
  misc_feature 1..116: note = Description of Artificial Sequence: Syntheticpolynucleotide
  source 1..116: mol_type = other RNA
  modified_base 1: mod_base = um
  modified_base 2: mod_base = gm
  modified_base 3: mod_base = um
  modified_base 114: mod_base = um
  modified_base 115: mod_base = um
  modified_base 116: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 113^114: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
tgtggaagagagaacattttgttgagaatctttcgaaagaaagattcttaataaggcatccttccgatgctgacttctcaccgtccggctcctcttaggaacgggcggtatgtttt

SEQ ID NO: 6782 - DNA, 20 bp, unidentified
  misc_feature 1..20: note = Description of Unknown:MG3-8-TRBC1/2-target site-D3 sequence
  source 1..20: mol_type = other DNA
aggtcctctggaaagggaag

SEQ ID NO: 6783 - DNA, 20 bp, unidentified
  misc_feature 1..20: note = Description of Unknown:MG3-8-TRBC1/2-target site-E3 sequence
  source 1..20: mol_type = other DNA
ctgaacaaggtgttcccacc

SEQ ID NO: 6784 - DNA, 20 bp, unidentified
  misc_feature 1..20: note = Description of Unknown:MG3-8-TRBC1/2-target site-F3 sequence
  source 1..20: mol_type = other DNA
ctcgggtgggaacaccttgt

SEQ ID NO: 6785 - DNA, 20 bp, unidentified
  misc_feature 1..20: note = Description of Unknown:MG3-8-TRBC1/2-target site-G3 sequence
  source 1..20: mol_type = other DNA
aatgggaaggaggtgcacag

SEQ ID NO: 6786 - DNA, 20 bp, unidentified
  misc_feature 1..20: note = Description of Unknown:MG3-8-TRBC1/2-target site-H3 sequence
  source 1..20: mol_type = other DNA
gggctgctccttgaggggct

SEQ ID NO: 6787 - DNA, 20 bp, unidentified
  misc_feature 1..20: note = Description of Unknown:MG3-8-TRBC1/2-target site-A4 sequence
  source 1..20: mol_type = other DNA
tactgcctgagcagccgcct

SEQ ID NO: 6788 - DNA, 20 bp, unidentified
  misc_feature 1..20: note = Description of Unknown:MG3-8-TRBC1/2-target site-B4 sequence
  source 1..20: mol_type = other DNA
ttgacagcggaagtggttgc

SEQ ID NO: 6789 - DNA, 20 bp, unidentified
  misc_feature 1..20: note = Description of Unknown:MG3-8-TRBC1/2-target site-C4 sequence
  source 1..20: mol_type = other DNA
gtgacgggtttggccctatc

SEQ ID NO: 6790 - DNA, 20 bp, unidentified
  misc_feature 1..20: note = Description of Unknown:MG3-8-TRBC1/2-target site-D4 sequence
  source 1..20: mol_type = other DNA
cggcgctgacgatctgggtg

SEQ ID NO: 6791 - DNA, 20 bp, unidentified
  misc_feature 1..20: note = Description of Unknown:MG3-8-TRBC1/2-target site-E4 sequence
  source 1..20: mol_type = other DNA
ccaacagtgtcctaccagca

SEQ ID NO: 6792 - DNA, 20 bp, unidentified
  misc_feature 1..20: note = Description of Unknown:MG3-8-TRBC1/2-target site-F4 sequence
  source 1..20: mol_type = other DNA
cctgcagaagagaaagtttt

SEQ ID NO: 6793 - DNA, 20 bp, unidentified
  misc_feature 1..20: note = Description of Unknown:MG3-8-TRBC1/2-target site-G4 sequence
  source 1..20: mol_type = other DNA
ctgaaaaacgtgttcccacc

SEQ ID NO: 6794 - DNA, 20 bp, unidentified
  misc_feature 1..20: note = Description of Unknown:MG3-8-TRBC1/2-target site-H4 sequence
  source 1..20: mol_type = other DNA
cttgggtgggaacacgtttt

SEQ ID NO: 6795 - DNA, 20 bp, unidentified
  misc_feature 1..20: note = Description of Unknown:MG3-8-TRBC1/2-target site-A5 sequence
  source 1..20: mol_type = other DNA
aatgggaaggaggtgcacag

SEQ ID NO: 6796 - DNA, 20 bp, unidentified
  misc_feature 1..20: note = Description of Unknown:MG3-8-TRBC1/2-target site-B5 sequence
  source 1..20: mol_type = other DNA
gggctgctccttgaggggct

SEQ ID NO: 6797 - DNA, 20 bp, unidentified
  misc_feature 1..20: note = Description of Unknown:MG3-8-TRBC1/2-target site-C5 sequence
  source 1..20: mol_type = other DNA
tactgcctgagcagccgcct

SEQ ID NO: 6798 - DNA, 20 bp, unidentified
  misc_feature 1..20: note = Description of Unknown:MG3-8-TRBC1/2-target site-D5 sequence
  source 1..20: mol_type = other DNA
ttgacagcggaagtggttgc

SEQ ID NO: 6799 - DNA, 20 bp, unidentified
  misc_feature 1..20: note = Description of Unknown:MG3-8-TRBC1/2-target site-E5 sequence
  source 1..20: mol_type = other DNA
gtgacaggtttggccctatc

SEQ ID NO: 6800 - DNA, 20 bp, unidentified
  misc_feature 1..20: note = Description of Unknown:MG3-8-TRBC1/2-target site-F5 sequence
  source 1..20: mol_type = other DNA
cggcgctgacgatctgggtg

SEQ ID NO: 6801 - DNA, 20 bp, unidentified
  misc_feature 1..20: note = Description of Unknown:MG3-8-TRBC1/2-target site-G5 sequence
  source 1..20: mol_type = other DNA
tcaacagagtcttaccagca

SEQ ID NO: 6802 - DNA, 20 bp, unidentified
  misc_feature 1..20: note = Description of Unknown:MG3-8-TRBC1/2-target site-H5 sequence
  source 1..20: mol_type = other DNA
tgtggaagagagaacatttt

SEQ ID NO: 6803 - DNA, 3776 bp, synthetic construct
  misc_feature 1..3776: note = Description of Artificial Sequence: Syntheticpolynucleotide
  source 1..3776: mol_type = other DNA
aaaagccagctccagcaggcgctgctcactcctccccatcctctccctctgtccctctgtccctctgaccctgcactgtcccagcaccatggcccccaagaagaagcggaaagttaccggtggcggaggcagcagcaccgacatgaagaactaccgcatcggagtggacgtgggcgacagaagcgtgggactggccgccatcgaattcgacgacgacgggctgcccatccagaaactggcactggtgaccttccggcacgacggcggcctggaccccacgaagaacaagacaccgatgagcaggaaagagacgaggggaatcgcacgcagaacaatgaggatgaaccgagaaaggaagaggcgcctgagaaacctggacaacgtgctggaaaacctgggctacagcgtgcccgagggccccgagcccgaaacctacgaagcatggaccagccgggcactgctggccagcatcaagctggccagcgcagacgaactgaacgaacacctggtgcgagcggtgaggcacatggcacgccaccgaggatgggccaacccctggtggagcctggaccagctggaaaaggcaagccaggagcccagcgaaacattcgagatcatcctggcccgggccagggagctgttcggggagaaagtgcccgcaaaccccaccctgggcatgctgggagcactggccgcgaacaacgaagtgctgctgcgcccgagggacgagaagaagaggaagaccggatacgtgagagggacacccctgatgttcgcacaagtgcgacaaggcgaccaactggcagaactgaggcgaatctgcgaggtgcaagggatcgaagaccaatacgaggcactgcggctgggcgtgttcgaccacaaacacccctacgtgccaaaagagagagtgggaaaagacccgctgaaccccagcacaaaccgcacaatcagggcgagcctggagttccaagaattcagaatcctggacagcgtggccaacctgagagtgagaatcggcagcagggcgaaaagagagctgaccgaggccgaatacgacgcagccgtggaattcctgatggactacgcggacaaggagcagcccagctgggccgacgtggccgaaaagatcggcgtgcccggaaaccgactggtggcccccgtgctggaagacgtgcaacagaaaaccgcaccctacgacagaagcagcgcagcattcgagaaagcgatggggaagaagaccgaggcaagacaatggtgggagagcaccgacgacgaccaactgagaagcctgctgatcgcattcctggtggacgccacgaacgacacagaagaggccgccgccgaggcgggactgagcgaactgtacaagagctggcccgcagaagagagagaggccctgagcaacatcgacttcgagaaaggaagggtggcatacagccaagagaccctgagcaaactgagcgaatacatgcacgaatacagagtgggactgcacgaggcccgcaaagcagtgttcggggtggacgacacctggagaccaccactggacaaactggaggagccaacaggccaacccgcagtggacagagtgctgacaatcctgcgacggttcgtgctggactgcgagaggcaatggggccgccccagggccatcaccgtggaacacaccagaaccggcctgatggggccgacccagcgccagaaaatcctgaacgaacaaaagaagaaccgggccgacaacgagcgaatcagagacgagctgagggaaagcggggtggacaaccccagcagggccgaagtgcgaagacacctgatcgtgcaagaacaagagtgccaatgcctgtactgcggaaccatgatcaccacaaccacgagcgagctggaccacatcgtgccccgcgccggaggaggcagcagccgaagagaaaacctggccgcagtgtgcagggcctgcaacgcgaagaagaagcgcgagctgttctacgcctgggcaggcccggtgaaaagccaagaaacaatcgagcgcgtgcgccaactgaaagcattcaaagacagcaagaaggcgaaaatgttcaagaaccagatccggcgactgaaccaaaccgaggcagacgagccaatcgacgagagaagcctggccagcaccagctacgcagccgtggcagtgagggaacgcctggagcaacacttcaacgaagggctggccctggacgacaaaagccgggtggtgctggacgtctacgcgggagccgtgaccagggagagccgcagagcaggcgggatcgacgaaagaatcctgctgcggggcgagcgcgacaagaacagattcgacgtgcggcaccacgccgtggacgcggccgtgatgaccctgctgaaccgcagcgtggccctgaccctggagcaacgcagccaactgcgacgcacattctacgaacaaggcctggacaaactggaccggaaccaactgaaacccgaggaagactggcgagacttcacagggctggcccccgccagccaagagaagttcctggaatggcgaaaggcggcaaccatcctgggcgacctgctggccgaggcgatcgaggacgacagcatcgcagtggtgagccccctgagactgaggccacaaaacggcagcgtgcacctggagacaatcagcgccgtgaagaaacagacactgggaagcgactggcccgccgacgccgtgaaaaggatcgtggacccagagatctacctggccatgaaagacgcactgggcaagctgaaagaactgccagaggacagcgcacggagcctggagctgccggacggcaggttcgtggaggccgacgacgaagtgctgttcttccccgaaaacgccgccagcatcctgacccccagaggggtggccgaaatcggcggcagcatccaccacgcgcggctgtacggctggctgaccaagaaaggggagctgaaagtgggcatgctgagggtgtacggagcagagttcccctggctgatgagggaaagcggcagcagaaacgtgctgagcatgcccatccaccgcggcagccagagcttcagggacatgcaagacaccaccagaaaagccgtggaaagcggagaagccgtggaattcgcctggatcacacagaacgacgaactggaattcgacccggacgactacatcgcccacggcggaaaagacgagctgagacaattcctggggttcatgcccgagtgccgctggcgagtggacggcttcaagaagaactaccagatccgcatccgaccagccatgctgagccgcgagcagctgcccagcgacatccaacgcaggctggaaagcaaaacactgaccaagaacgagagcctgctgctgaaagcactggacaccgggctggtggtggcaatcggcggcctgctgcccctggaaacactgaaggtgatccggagaaacaacctgggcttcccacgatggcgcgggaacgggaacctgccgaccagcttcgaagtgcggagcagcgcactgagagcactgggcgtggaaggatctggcggaaaaagacctgccgccacaaagaaagccggacaggccaagaaaaagaagtgaccacacccccattcccccactccagatagaacttcagttatatctcacgtgtctggagttggatcccttgaagactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 6804 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cgaatcctcctcctgaaagtgggttgagaatcgaaagattcttaataaggcatccttccgatgctgacttctcaccgtccgttttccaataggagcgggcggtatgtttt

SEQ ID NO: 6805 - DNA, 22 bp, unidentified
  misc_feature 1..22: note = Description of Unknown:MG3-6-TRAC-target site-6 sequence
  source 1..22: mol_type = other DNA
cgaatcctcctcctgaaagtgg

SEQ ID NO: 6806 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
aggaatctgcctaacaggaggtgttgagaatcgaaagattcttaataaggcatccttccgatgctgacttctcaccgtccgttttccaataggagcgggcggtatgtttt

SEQ ID NO: 6807 - DNA, 22 bp, unidentified
  misc_feature 1..22: note = Description of Unknown:MG3-6-AAVS1-target site-B2 sequence
  source 1..22: mol_type = other DNA
aggaatctgcctaacaggaggt

SEQ ID NO: 6808 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
taggaaggaggaggcctaaggagttgagaatcgaaagattcttaataaggcatccttccgatgctgacttctcaccgtccgttttccaataggagcgggcggtatgtttt

SEQ ID NO: 6809 - DNA, 22 bp, unidentified
  misc_feature 1..22: note = Description of Unknown:MG3-6-AAVS1-target site-D2 sequence
  source 1..22: mol_type = other DNA
taggaaggaggaggcctaagga

SEQ ID NO: 6810 - DNA, 4263 bp, synthetic construct
  misc_feature 1..4263: note = Description of Artificial Sequence: Syntheticpolynucleotide
  source 1..4263: mol_type = other DNA
caatggtcctgtctctcaagaatcccctgccactcctcacacccaccctgggcccatattcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagttaattaatgaatgaatgaaataaaagatctttattttcattagatctgtgtgttggttttttgtgtgatcctcgagggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaaatgaccctgtgccttatttgaactaaccaatcagttcgcttctcgcttctgttcgcgcgcttctgctccccgagctcaataaaagagcccacaacccctcactcggcgcgcgccagtccggtaccagtcgccaccatggccctgcctgtgacagctctgctcctccctctggccctgctgctccatgccgccagacccgacatcgtgctgacccagagcccccccagcctggccatgtctctgggcaagagagccaccatcagctgccgggccagcgagagcgtgaccatcctgggcagccacctgatccactggtatcagcagaagcccggccagccccccaccctgctgatccagctcgccagcaatgtgcagaccggcgtgcccgccagattcagcggcagcggcagcagaaccgacttcaccctgaccatcgaccccgtggaagaggacgacgtggccgtgtactactgcctgcagagccggaccatcccccggacctttggcggaggcaccaaactggaaatcaagggcagcaccagcggctccggcaagcctggctctggcgagggcagcacaaagggacagattcagctggtgcagagcggccctgagctgaagaaacccggcgagacagtgaagatcagctgcaaggcctccggctacaccttcaccgactacagcatcaactgggtgaaaagagcccctggcaagggcctgaagtggatgggctggatcaacaccgagacaagagagcccgcctacgcctacgacttccggggcagattcgccttcagcctggaaaccagcgccagcaccgcctacctgcagatcaacaacctgaagtacgaggacaccgccacctacttttgcgccctggactacagctacgccatggactactggggccagggcaccagcgtgaccgtgtccagcttcgtgcccgtgttcctgcccgccaaacctaccaccacccctgcccctagacctcccaccccagccccaacaatcgccagccagcctctgtctctgcggcccgaagcctgtagacctgctgccggcggagccgtgcacaccagaggcctggacttcgcctgcgacatctacatctgggcccctctggccggcacctgtggcgtgctgctgctgagcctggtgatcaccctgtactgcaaccaccggaacagaagcaagcggagccggctgctgcacagcgactacatgaacatgaccccaagacggcctggccccacccggaagcactaccagccttacgcccctcccagagacttcgccgcctaccggtccagagtgaagttcagcagatccgccgacgcccctgcctaccagcagggacagaaccagctgtacaacgagctgaacctgggcagacgggaagagtacgacgtgctggacaagcggagaggccgggaccccgagatgggcggaaagcccagacggaagaacccccaggaaggcctgtataacgaactgcagaaagacaagatggccgaggcctacagcgagatcggcatgaagggcgagcggaggcgcggcaagggccacgatggcctgtaccagggcctgagcaccgccaccaaggacacctacgacgccctgcacatgcaggccctgccccccagaggatccggcgctacaaatttttcactgctgaaacaggcgggtgatgtggaggagaaccctggacccatgggtgctggcgcaactggacgcgctatggatggacctcgcttgctgcttcttctgcttctcggggtctcattgggtggtgctaaggaagcatgcccaacgggactttatacgcatagcggagagtgttgcaaagcttgtaacctgggcgaaggcgtcgcgcaaccttgtggtgcaaatcaaaccgtctgcgagccatgtttggactctgttacgtttagtgacgtagtatctgcgacagagccatgcaagccttgtacggaatgtgtaggattgcagagcatgtctgccccttgtgtagaagccgacgatgcagtttgcaggtgcgcgtatggctattaccaagacgaaacaaccggacgatgtgaagcttgccgagtttgtgaagcgggttccgggcttgtattctcatgtcaggataagcagaacaccgtctgcgaagagtgccccgatggcacctacagcgatgaagcgaaccatgtagacccctgcctgccttgcaccgtttgtgaagacacggaacgacagttgcgggagtgtacccggtgggcagacgccgagtgcgaagagattccaggccgctggatcacgcgaagtaccccgccagaaggttccgacagtactgcaccaagcacccaagaaccagaggcgccccccgagcaggacctgattgcctccaccgtggcgggtgttgttactacggttatgggctcatcccagcccgttgttacccgaggaactacagacaacctgattccggtatattgttctatcttggcggctgtagtagttggcttggtcgcgtacatcgctttcaaaagatgaaagcttgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggaacttgtttattgcagcttataatggttacaaataaagcaatagcatcacaaatttcacaaataaagcatttttttcactgcattctagttgtggtttgtccaaactcatcaatgtatcttagtttaaactggccgggtttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctc

SEQ ID NO: 6811 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
atttacatggaaagctcatcttgttgagaatcgaaagattcttaataaggcatccttccgatgctgacttctcaccgtccgttttccaataggagcgggcggtatgtttt

SEQ ID NO: 6812 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tttttataggtgcagtctccaagttgagaatcgaaagattcttaataaggcatccttccgatgctgacttctcaccgtccgttttccaataggagcgggcggtatgtttt

SEQ ID NO: 6813 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgccttggaaacctggggtgccgttgagaatcgaaagattcttaataaggcatccttccgatgctgacttctcaccgtccgttttccaataggagcgggcggtatgtttt

SEQ ID NO: 6814 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gggaaaaaacttcagacaagaagttgagaatcgaaagattcttaataaggcatccttccgatgctgacttctcaccgtccgttttccaataggagcgggcggtatgtttt

SEQ ID NO: 6815 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ttgcacaattcagaaaagagaagttgagaatcgaaagattcttaataaggcatccttccgatgctgacttctcaccgtccgttttccaataggagcgggcggtatgtttt

SEQ ID NO: 6816 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2-O-methyladenosine
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gaactctgaaaattaagcatctgttgagaatcgaaagattcttaataaggcatccttccgatgctgacttctcaccgtccgttttccaataggagcgggcggtatgtttt

SEQ ID NO: 6817 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgttggaaaaaatatttgatttgttgagaatcgaaagattcttaataaggcatccttccgatgctgacttctcaccgtccgttttccaataggagcgggcggtatgtttt

SEQ ID NO: 6818 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgatgtcctgacccaaggcaccgttgagaatcgaaagattcttaataaggcatccttccgatgctgacttctcaccgtccgttttccaataggagcgggcggtatgtttt

SEQ ID NO: 6819 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccaaggcattcgtaatctctttgttgagaatcgaaagattcttaataaggcatccttccgatgctgacttctcaccgtccgttttccaataggagcgggcggtatgtttt

SEQ ID NO: 6820 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ttttagagagggtctcaaaaccgttgagaatcgaaagattcttaataaggcatccttccgatgctgacttctcaccgtccgttttccaataggagcgggcggtatgtttt

SEQ ID NO: 6821 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gggtctcaaaaccaaagatctcgttgagaatcgaaagattcttaataaggcatccttccgatgctgacttctcaccgtccgttttccaataggagcgggcggtatgtttt

SEQ ID NO: 6822 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggaaacatctaaaactttctcagttgagaatcgaaagattcttaataaggcatccttccgatgctgacttctcaccgtccgttttccaataggagcgggcggtatgtttt

SEQ ID NO: 6823 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ctcagagggtcatcacacacaagttgagaatcgaaagattcttaataaggcatccttccgatgctgacttctcaccgtccgttttccaataggagcgggcggtatgtttt

SEQ ID NO: 6824 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccgccacgcacctggacagctggttgagaatcgaaagattcttaataaggcatccttccgatgctgacttctcaccgtccgttttccaataggagcgggcggtatgtttt

SEQ ID NO: 6825 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 108: mod_base = um
  modified_base 109: mod_base = gm
  modified_base 110: mod_base = gm
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tggacagctgacaggctcgacagttgagaatcgaaagattcttaataaggcatccttccgatgctgacttctcaccgtccgttttccaataggagcgggcggtatgtttt

SEQ ID NO: 6826 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gctgtgcacttgaattttgcacgttgagaatcgaaagattcttaataaggcatccttccgatgctgacttctcaccgtccgttttccaataggagcgggcggtatgtttt

SEQ ID NO: 6827 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tttagatgtttcccatcttgatgttgagaatcgaaagattcttaataaggcatccttccgatgctgacttctcaccgtccgttttccaataggagcgggcggtatgtttt

SEQ ID NO: 6828 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccatcttgatacaggtttaattgttgagaatcgaaagattcttaataaggcatccttccgatgctgacttctcaccgtccgttttccaataggagcgggcggtatgtttt

SEQ ID NO: 6829 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggtcagttccattcattacctcgttgagaatcgaaagattcttaataaggcatccttccgatgctgacttctcaccgtccgttttccaataggagcgggcggtatgtttt

SEQ ID NO: 6830 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ttccattcattacctcacaggtgttgagaatcgaaagattcttaataaggcatccttccgatgctgacttctcaccgtccgttttccaataggagcgggcggtatgtttt

SEQ ID NO: 6831 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gggttgtgttgatacaagtccagttgagaatcgaaagattcttaataaggcatccttccgatgctgacttctcaccgtccgttttccaataggagcgggcggtatgtttt

SEQ ID NO: 6832 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
aagtccaggagatctttggtttgttgagaatcgaaagattcttaataaggcatccttccgatgctgacttctcaccgtccgttttccaataggagcgggcggtatgtttt

SEQ ID NO: 6833 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggcagcatccttggccagagtagttgagaatcgaaagattcttaataaggcatccttccgatgctgacttctcaccgtccgttttccaataggagcgggcggtatgtttt

SEQ ID NO: 6834 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gccagagtaatgggctctctgcgttgagaatcgaaagattcttaataaggcatccttccgatgctgacttctcaccgtccgttttccaataggagcgggcggtatgtttt

SEQ ID NO: 6835 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cacttctcttccttttgcagaggttgagaatcgaaagattcttaataaggcatccttccgatgctgacttctcaccgtccgttttccaataggagcgggcggtatgtttt

SEQ ID NO: 6836 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2-O-methyladenosine
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tatagaaaacgagcagtgccacgttgagaatcgaaagattcttaataaggcatccttccgatgctgacttctcaccgtccgttttccaataggagcgggcggtatgtttt

SEQ ID NO: 6837 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
agcagtgccacaaagaccatcagttgagaatcgaaagattcttaataaggcatccttccgatgctgacttctcaccgtccgttttccaataggagcgggcggtatgtttt

SEQ ID NO: 6838 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
atgccaatgatgagatagatgtgttgagaatcgaaagattcttaataaggcatccttccgatgctgacttctcaccgtccgttttccaataggagcgggcggtatgtttt

SEQ ID NO: 6839 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2-O-methyladenosine
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gaagagaagtgggatggctggggttgagaatcgaaagattcttaataaggcatccttccgatgctgacttctcaccgtccgttttccaataggagcgggcggtatgtttt

SEQ ID NO: 6840 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccacagagtagctactgaagaagttgagaatcgaaagattcttaataaggcatccttccgatgctgacttctcaccgtccgttttccaataggagcgggcggtatgtttt

SEQ ID NO: 6841 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cgtgttcagcaccagcctcagagttgagaatcgaaagattcttaataaggcatccttccgatgctgacttctcaccgtccgttttccaataggagcgggcggtatgtttt

SEQ ID NO: 6842 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gggcacacaagttcaccagcaggttgagaatcgaaagattcttaataaggcatccttccgatgctgacttctcaccgtccgttttccaataggagcgggcggtatgtttt

SEQ ID NO: 6843 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cagcagaaaggcccgcccctccgttgagaatcgaaagattcttaataaggcatccttccgatgctgacttctcaccgtccgttttccaataggagcgggcggtatgtttt

SEQ ID NO: 6844 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgagttttctgctgccccatgggttgagaatcgaaagattcttaataaggcatccttccgatgctgacttctcaccgtccgttttccaataggagcgggcggtatgtttt

SEQ ID NO: 6845 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
atggggaggttttggctgaactgttgagaatcgaaagattcttaataaggcatccttccgatgctgacttctcaccgtccgttttccaataggagcgggcggtatgtttt

SEQ ID NO: 6846 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgaactcgaggtctggggaggggttgagaatcgaaagattcttaataaggcatccttccgatgctgacttctcaccgtccgttttccaataggagcgggcggtatgtttt

SEQ ID NO: 6847 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
aacttgtgtgcccgacggagcagttgagaatcgaaagattcttaataaggcatccttccgatgctgacttctcaccgtccgttttccaataggagcgggcggtatgtttt

SEQ ID NO: 6848 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cgacggagcaggaggcctcttcgttgagaatcgaaagattcttaataaggcatccttccgatgctgacttctcaccgtccgttttccaataggagcgggcggtatgtttt

SEQ ID NO: 6849 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggaggaggatgttgggaagttggttgagaatcgaaagattcttaataaggcatccttccgatgctgacttctcaccgtccgttttccaataggagcgggcggtatgtttt

SEQ ID NO: 6850 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gttgggaagttgctggattctggttgagaatcgaaagattcttaataaggcatccttccgatgctgacttctcaccgtccgttttccaataggagcgggcggtatgtttt

SEQ ID NO: 6851 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
aggggttgaagctggaatttgggttgagaatcgaaagattcttaataaggcatccttccgatgctgacttctcaccgtccgttttccaataggagcgggcggtatgtttt

SEQ ID NO: 6852 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccctttcttcagtagctactctgttgagaatcgaaagattcttaataaggcatccttccgatgctgacttctcaccgtccgttttccaataggagcgggcggtatgtttt

SEQ ID NO: 6853 - DNA, 22 bp, unidentified
  misc_feature 1..22: note = Description of Unknown:MG3-6-CD2-target site-A1 sequence
  source 1..22: mol_type = other DNA
atttacatggaaagctcatctt

SEQ ID NO: 6854 - DNA, 22 bp, unidentified
  misc_feature 1..22: note = Description of Unknown:MG3-6-CD2-target site-B1 sequence
  source 1..22: mol_type = other DNA
tttttataggtgcagtctccaa

SEQ ID NO: 6855 - DNA, 22 bp, unidentified
  misc_feature 1..22: note = Description of Unknown:MG3-6-CD2-target site-C1 sequence
  source 1..22: mol_type = other DNA
tgccttggaaacctggggtgcc

SEQ ID NO: 6856 - DNA, 22 bp, unidentified
  misc_feature 1..22: note = Description of Unknown:MG3-6-CD2-target site-D1 sequence
  source 1..22: mol_type = other DNA
gggaaaaaacttcagacaagaa

SEQ ID NO: 6857 - DNA, 22 bp, unidentified
  misc_feature 1..22: note = Description of Unknown:MG3-6-CD2-target site-E1 sequence
  source 1..22: mol_type = other DNA
ttgcacaattcagaaaagagaa

SEQ ID NO: 6858 - DNA, 22 bp, unidentified
  misc_feature 1..22: note = Description of Unknown:MG3-6-CD2-target site-F1 sequence
  source 1..22: mol_type = other DNA
gaactctgaaaattaagcatct

SEQ ID NO: 6859 - DNA, 22 bp, unidentified
  misc_feature 1..22: note = Description of Unknown:MG3-6-CD2-target site-G1 sequence
  source 1..22: mol_type = other DNA
tgttggaaaaaatatttgattt

SEQ ID NO: 6860 - DNA, 22 bp, unidentified
  misc_feature 1..22: note = Description of Unknown:MG3-6-CD2-target site-H1 sequence
  source 1..22: mol_type = other DNA
tgatgtcctgacccaaggcacc

SEQ ID NO: 6861 - DNA, 22 bp, unidentified
  misc_feature 1..22: note = Description of Unknown:MG3-6-CD2-target site-A2 sequence
  source 1..22: mol_type = other DNA
ccaaggcattcgtaatctcttt

SEQ ID NO: 6862 - DNA, 22 bp, unidentified
  misc_feature 1..22: note = Description of Unknown:MG3-6-CD2-target site-B2 sequence
  source 1..22: mol_type = other DNA
ttttagagagggtctcaaaacc

SEQ ID NO: 6863 - DNA, 22 bp, unidentified
  misc_feature 1..22: note = Description of Unknown:MG3-6-CD2-target site-C2 sequence
  source 1..22: mol_type = other DNA
gggtctcaaaaccaaagatctc

SEQ ID NO: 6864 - DNA, 22 bp, unidentified
  misc_feature 1..22: note = Description of Unknown:MG3-6-CD2-target site-D2 sequence
  source 1..22: mol_type = other DNA
ggaaacatctaaaactttctca

SEQ ID NO: 6865 - DNA, 22 bp, unidentified
  misc_feature 1..22: note = Description of Unknown:MG3-6-CD2-target site-E2 sequence
  source 1..22: mol_type = other DNA
ctcagagggtcatcacacacaa

SEQ ID NO: 6866 - DNA, 22 bp, unidentified
  misc_feature 1..22: note = Description of Unknown:MG3-6-CD2-target site-F2 sequence
  source 1..22: mol_type = other DNA
ccgccacgcacctggacagctg

SEQ ID NO: 6867 - DNA, 22 bp, unidentified
  misc_feature 1..22: note = Description of Unknown:MG3-6-CD2-target site-G2 sequence
  source 1..22: mol_type = other DNA
tggacagctgacaggctcgaca

SEQ ID NO: 6868 - DNA, 22 bp, unidentified
  misc_feature 1..22: note = Description of Unknown:MG3-6-CD2-target site-H2 sequence
  source 1..22: mol_type = other DNA
gctgtgcacttgaattttgcac

SEQ ID NO: 6869 - DNA, 22 bp, unidentified
  misc_feature 1..22: note = Description of Unknown:MG3-6-CD2-target site-A3 sequence
  source 1..22: mol_type = other DNA
tttagatgtttcccatcttgat

SEQ ID NO: 6870 - DNA, 22 bp, unidentified
  misc_feature 1..22: note = Description of Unknown:MG3-6-CD2-target site-B3 sequence
  source 1..22: mol_type = other DNA
ccatcttgatacaggtttaatt

SEQ ID NO: 6871 - DNA, 22 bp, unidentified
  misc_feature 1..22: note = Description of Unknown:MG3-6-CD2-target site-C3 sequence
  source 1..22: mol_type = other DNA
ggtcagttccattcattacctc

SEQ ID NO: 6872 - DNA, 22 bp, unidentified
  misc_feature 1..22: note = Description of Unknown:MG3-6-CD2-target site-D3 sequence
  source 1..22: mol_type = other DNA
ttccattcattacctcacaggt

SEQ ID NO: 6873 - DNA, 22 bp, unidentified
  misc_feature 1..22: note = Description of Unknown:MG3-6-CD2-target site-E3 sequence
  source 1..22: mol_type = other DNA
gggttgtgttgatacaagtcca

SEQ ID NO: 6874 - DNA, 22 bp, unidentified
  misc_feature 1..22: note = Description of Unknown:MG3-6-CD2-target site-F3 sequence
  source 1..22: mol_type = other DNA
aagtccaggagatctttggttt

SEQ ID NO: 6875 - DNA, 22 bp, unidentified
  misc_feature 1..22: note = Description of Unknown:MG3-6-CD2-target site-G3 sequence
  source 1..22: mol_type = other DNA
ggcagcatccttggccagagta

SEQ ID NO: 6876 - DNA, 22 bp, unidentified
  misc_feature 1..22: note = Description of Unknown:MG3-6-CD2-target site-H3 sequence
  source 1..22: mol_type = other DNA
gccagagtaatgggctctctgc

SEQ ID NO: 6877 - DNA, 22 bp, unidentified
  misc_feature 1..22: note = Description of Unknown:MG3-6-CD2-target site-A4 sequence
  source 1..22: mol_type = other DNA
cacttctcttccttttgcagag

SEQ ID NO: 6878 - DNA, 22 bp, unidentified
  misc_feature 1..22: note = Description of Unknown:MG3-6-CD2-target site-B4 sequence
  source 1..22: mol_type = other DNA
tatagaaaacgagcagtgccac

SEQ ID NO: 6879 - DNA, 22 bp, unidentified
  misc_feature 1..22: note = Description of Unknown:MG3-6-CD2-target site-C4 sequence
  source 1..22: mol_type = other DNA
agcagtgccacaaagaccatca

SEQ ID NO: 6880 - DNA, 22 bp, unidentified
  misc_feature 1..22: note = Description of Unknown:MG3-6-CD2-target site-D4 sequence
  source 1..22: mol_type = other DNA
atgccaatgatgagatagatgt

SEQ ID NO: 6881 - DNA, 22 bp, unidentified
  misc_feature 1..22: note = Description of Unknown:MG3-6-CD2-target site-E4 sequence
  source 1..22: mol_type = other DNA
gaagagaagtgggatggctggg

SEQ ID NO: 6882 - DNA, 22 bp, unidentified
  misc_feature 1..22: note = Description of Unknown:MG3-6-CD2-target site-F4 sequence
  source 1..22: mol_type = other DNA
ccacagagtagctactgaagaa

SEQ ID NO: 6883 - DNA, 22 bp, unidentified
  misc_feature 1..22: note = Description of Unknown:MG3-6-CD2-target site-G4 sequence
  source 1..22: mol_type = other DNA
cgtgttcagcaccagcctcaga

SEQ ID NO: 6884 - DNA, 22 bp, unidentified
  misc_feature 1..22: note = Description of Unknown:MG3-6-CD2-target site-H4 sequence
  source 1..22: mol_type = other DNA
gggcacacaagttcaccagcag

SEQ ID NO: 6885 - DNA, 22 bp, unidentified
  misc_feature 1..22: note = Description of Unknown:MG3-6-CD2-target site-A5 sequence
  source 1..22: mol_type = other DNA
cagcagaaaggcccgcccctcc

SEQ ID NO: 6886 - DNA, 22 bp, unidentified
  misc_feature 1..22: note = Description of Unknown:MG3-6-CD2-target site-B5 sequence
  source 1..22: mol_type = other DNA
tgagttttctgctgccccatgg

SEQ ID NO: 6887 - DNA, 22 bp, unidentified
  misc_feature 1..22: note = Description of Unknown:MG3-6-CD2-target site-C5 sequence
  source 1..22: mol_type = other DNA
atggggaggttttggctgaact

SEQ ID NO: 6888 - DNA, 22 bp, unidentified
  misc_feature 1..22: note = Description of Unknown:MG3-6-CD2-target site-D5 sequence
  source 1..22: mol_type = other DNA
tgaactcgaggtctggggaggg

SEQ ID NO: 6889 - DNA, 22 bp, unidentified
  misc_feature 1..22: note = Description of Unknown:MG3-6-CD2-target site-E5 sequence
  source 1..22: mol_type = other DNA
aacttgtgtgcccgacggagca

SEQ ID NO: 6890 - DNA, 22 bp, unidentified
  misc_feature 1..22: note = Description of Unknown:MG3-6-CD2-target site-F5 sequence
  source 1..22: mol_type = other DNA
cgacggagcaggaggcctcttc

SEQ ID NO: 6891 - DNA, 22 bp, unidentified
  misc_feature 1..22: note = Description of Unknown:MG3-6-CD2-target site-G5 sequence
  source 1..22: mol_type = other DNA
ggaggaggatgttgggaagttg

SEQ ID NO: 6892 - DNA, 22 bp, unidentified
  misc_feature 1..22: note = Description of Unknown:MG3-6-CD2-target site-H5 sequence
  source 1..22: mol_type = other DNA
gttgggaagttgctggattctg

SEQ ID NO: 6893 - DNA, 22 bp, unidentified
  misc_feature 1..22: note = Description of Unknown:MG3-6-CD2-target site-A6 sequence
  source 1..22: mol_type = other DNA
aggggttgaagctggaatttgg

SEQ ID NO: 6894 - DNA, 22 bp, unidentified
  misc_feature 1..22: note = Description of Unknown:MG3-6-CD2-target site-B6 sequence
  source 1..22: mol_type = other DNA
ccctttcttcagtagctactct

SEQ ID NO: 6895 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
agaaggccagaaaccatgcccagttgagaatcgaaagattcttaataaggcatccttccgatgctgacttctcaccgtccgttttccaataggagcgggcggtatgtttt

SEQ ID NO: 6896 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = OTHER; note = 2-O-methyladenosine
  modified_base 108: mod_base = um
  modified_base 109: mod_base = OTHER; note = 2-O-methyladenosine
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gtacaaggtggccagcggttgcgttgagaatcgaaagattcttaataaggcatccttccgatgctgacttctcaccgtccgttttccaataggagcgggcggtatgtttt

SEQ ID NO: 6897 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ttctgacccccagatttccagggttgagaatcgaaagattcttaataaggcatccttccgatgctgacttctcaccgtccgttttccaataggagcgggcggtatgtttt

SEQ ID NO: 6898 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = cm
  modified_base 110: mod_base = um
  modified_base 108: mod_base = um
  modified_base 109: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cacccgttccaactcgaagtgcgttgagaatcgaaagattcttaataaggcatccttccgatgctgacttctcaccgtccgttttccaataggagcgggcggtatgtttt

SEQ ID NO: 6899 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
actcgaagtgccagggccagctgttgagaatcgaaagattcttaataaggcatccttccgatgctgacttctcaccgtccgttttccaataggagcgggcggtatgtttt

SEQ ID NO: 6900 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gcacatggtttgcagccagagcgttgagaatcgaaagattcttaataaggcatccttccgatgctgacttctcaccgtccgttttccaataggagcgggcggtatgtttt

SEQ ID NO: 6901 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gggccggagctccaagcagtgggttgagaatcgaaagattcttaataaggcatccttccgatgctgacttctcaccgtccgttttccaataggagcgggcggtatgtttt

SEQ ID NO: 6902 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ctcaatcatctgctacggacaagttgagaatcgaaagattcttaataaggcatccttccgatgctgacttctcaccgtccgttttccaataggagcgggcggtatgtttt

SEQ ID NO: 6903 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cagaaatgacatgtgtcactctgttgagaatcgaaagattcttaataaggcatccttccgatgctgacttctcaccgtccgttttccaataggagcgggcggtatgtttt

SEQ ID NO: 6904 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggctggctagttacccacctaagttgagaatcgaaagattcttaataaggcatccttccgatgctgacttctcaccgtccgttttccaataggagcgggcggtatgtttt

SEQ ID NO: 6905 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gctagttacccacctaagcagggttgagaatcgaaagattcttaataaggcatccttccgatgctgacttctcaccgtccgttttccaataggagcgggcggtatgtttt

SEQ ID NO: 6906 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgaggtgtgtaggtgacaaggagttgagaatcgaaagattcttaataaggcatccttccgatgctgacttctcaccgtccgttttccaataggagcgggcggtatgtttt

SEQ ID NO: 6907 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gtgtaggtgacaaggaaggggcgttgagaatcgaaagattcttaataaggcatccttccgatgctgacttctcaccgtccgttttccaataggagcgggcggtatgtttt

SEQ ID NO: 6908 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gcaccccacagttcagccgctggttgagaatcgaaagattcttaataaggcatccttccgatgctgacttctcaccgtccgttttccaataggagcgggcggtatgtttt

SEQ ID NO: 6909 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tggcagacttttgacgcttgacgttgagaatcgaaagattcttaataaggcatccttccgatgctgacttctcaccgtccgttttccaataggagcgggcggtatgtttt

SEQ ID NO: 6910 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccatgtgccatccgtccttgaggttgagaatcgaaagattcttaataaggcatccttccgatgctgacttctcaccgtccgttttccaataggagcgggcggtatgtttt

SEQ ID NO: 6911 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggtgagccttgcctggaaatctgttgagaatcgaaagattcttaataaggcatccttccgatgctgacttctcaccgtccgttttccaataggagcgggcggtatgtttt

SEQ ID NO: 6912 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cagaagacaacacctccaacgagttgagaatcgaaagattcttaataaggcatccttccgatgctgacttctcaccgtccgttttccaataggagcgggcggtatgtttt

SEQ ID NO: 6913 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
caactccagagcccacaggtaagttgagaatcgaaagattcttaataaggcatccttccgatgctgacttctcaccgtccgttttccaataggagcgggcggtatgtttt

SEQ ID NO: 6914 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gggctctggagttgtggtgggcgttgagaatcgaaagattcttaataaggcatccttccgatgctgacttctcaccgtccgttttccaataggagcgggcggtatgtttt

SEQ ID NO: 6915 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgtcgttggaggtgttgtcttcgttgagaatcgaaagattcttaataaggcatccttccgatgctgacttctcaccgtccgttttccaataggagcgggcggtatgtttt

SEQ ID NO: 6916 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ctctctcctctcctagctcctcgttgagaatcgaaagattcttaataaggcatccttccgatgctgacttctcaccgtccgttttccaataggagcgggcggtatgtttt

SEQ ID NO: 6917 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gcctggggggtaccatcagctagttgagaatcgaaagattcttaataaggcatccttccgatgctgacttctcaccgtccgttttccaataggagcgggcggtatgtttt

SEQ ID NO: 6918 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccatcagctatgaggcccaggagttgagaatcgaaagattcttaataaggcatccttccgatgctgacttctcaccgtccgttttccaataggagcgggcggtatgtttt

SEQ ID NO: 6919 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ctatgaggcccaggacaagaccgttgagaatcgaaagattcttaataaggcatccttccgatgctgacttctcaccgtccgttttccaataggagcgggcggtatgtttt

SEQ ID NO: 6920 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gctccttcttgaagcatctgccgttgagaatcgaaagattcttaataaggcatccttccgatgctgacttctcaccgtccgttttccaataggagcgggcggtatgtttt

SEQ ID NO: 6921 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
agagactgaggcaggcagagccgttgagaatcgaaagattcttaataaggcatccttccgatgctgacttctcaccgtccgttttccaataggagcgggcggtatgtttt

SEQ ID NO: 6922 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
accagcccttgccaatccaatggttgagaatcgaaagattcttaataaggcatccttccgatgctgacttctcaccgtccgttttccaataggagcgggcggtatgtttt

SEQ ID NO: 6923 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgccctcctttgctcaggtaaggttgagaatcgaaagattcttaataaggcatccttccgatgctgacttctcaccgtccgttttccaataggagcgggcggtatgtttt

SEQ ID NO: 6924 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggcaagaactcggccacttttcgttgagaatcgaaagattcttaataaggcatccttccgatgctgacttctcaccgtccgttttccaataggagcgggcggtatgtttt

SEQ ID NO: 6925 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ccagggaggtacagcttgagttgttgagaatcgaaagattcttaataaggcatccttccgatgctgacttctcaccgtccgttttccaataggagcgggcggtatgtttt

SEQ ID NO: 6926 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
agcttgagttctggatcttccagttgagaatcgaaagattcttaataaggcatccttccgatgctgacttctcaccgtccgttttccaataggagcgggcggtatgtttt

SEQ ID NO: 6927 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ctggatcttccattggattggcgttgagaatcgaaagattcttaataaggcatccttccgatgctgacttctcaccgtccgttttccaataggagcgggcggtatgtttt

SEQ ID NO: 6928 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ggctggtgttcccgtggctcccgttgagaatcgaaagattcttaataaggcatccttccgatgctgacttctcaccgtccgttttccaataggagcgggcggtatgtttt

SEQ ID NO: 6929 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gttcccgtggctcccctgggtcgttgagaatcgaaagattcttaataaggcatccttccgatgctgacttctcaccgtccgttttccaataggagcgggcggtatgtttt

SEQ ID NO: 6930 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgcttcaagaaggagccacactgttgagaatcgaaagattcttaataaggcatccttccgatgctgacttctcaccgtccgttttccaataggagcgggcggtatgtttt

SEQ ID NO: 6931 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
aggttgttgcagaggaagttctgttgagaatcgaaagattcttaataaggcatccttccgatgctgacttctcaccgtccgttttccaataggagcgggcggtatgtttt

SEQ ID NO: 6932 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgcagaggaagttctccaggtcgttgagaatcgaaagattcttaataaggcatccttccgatgctgacttctcaccgtccgttttccaataggagcgggcggtatgtttt

SEQ ID NO: 6933 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tctccaggtcctgggtcttgtcgttgagaatcgaaagattcttaataaggcatccttccgatgctgacttctcaccgtccgttttccaataggagcgggcggtatgtttt

SEQ ID NO: 6934 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gcctcatagctgatggtaccccgttgagaatcgaaagattcttaataaggcatccttccgatgctgacttctcaccgtccgttttccaataggagcgggcggtatgtttt

SEQ ID NO: 6935 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cacgccggcacagtgctggccggttgagaatcgaaagattcttaataaggcatccttccgatgctgacttctcaccgtccgttttccaataggagcgggcggtatgtttt

SEQ ID NO: 6936 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aaggcaccgtggaggtgcgccagttgagaatcgaaagattcttaataaggcatccttccgatgctgacttctcaccgtccgttttccaataggagcgggcggtatgtttt

SEQ ID NO: 6937 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2-O-methyladenosine
  modified_base 3: mod_base = cm
  modified_base 109: mod_base = um
  modified_base 108: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gacgctggtgacccaacatcccgttgagaatcgaaagattcttaataaggcatccttccgatgctgacttctcaccgtccgttttccaataggagcgggcggtatgtttt

SEQ ID NO: 6938 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggacagaagagcccccgggatggttgagaatcgaaagattcttaataaggcatccttccgatgctgacttctcaccgtccgttttccaataggagcgggcggtatgtttt

SEQ ID NO: 6939 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tcctggctgaagagctgtcacagttgagaatcgaaagattcttaataaggcatccttccgatgctgacttctcaccgtccgttttccaataggagcgggcggtatgtttt

SEQ ID NO: 6940 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccccaccagacggctctgcaccgttgagaatcgaaagattcttaataaggcatccttccgatgctgacttctcaccgtccgttttccaataggagcgggcggtatgtttt

SEQ ID NO: 6941 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cccaggccaggatccaaaccccgttgagaatcgaaagattcttaataaggcatccttccgatgctgacttctcaccgtccgttttccaataggagcgggcggtatgtttt

SEQ ID NO: 6942 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttcactagcttcttgtaggcaagttgagaatcgaaagattcttaataaggcatccttccgatgctgacttctcaccgtccgttttccaataggagcgggcggtatgtttt

SEQ ID NO: 6943 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccagcagcaccaccaggagcacgttgagaatcgaaagattcttaataaggcatccttccgatgctgacttctcaccgtccgttttccaataggagcgggcggtatgtttt

SEQ ID NO: 6944 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atgcttgccaccgtgcctgcgggttgagaatcgaaagattcttaataaggcatccttccgatgctgacttctcaccgtccgttttccaataggagcgggcggtatgtttt

SEQ ID NO: 6945 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = cm
  modified_base 108^109: mod_base = OTHER; note = phosphorothioate bond
  modified_base 109: mod_base = um
  modified_base 108: mod_base = um
  modified_base 110: mod_base = um
  modified_base 107^108: mod_base = OTHER; note = phosphorothioate bond
  modified_base 109^110: mod_base = OTHER; note = phosphorothioate bond
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
accgtgcctgcggccaggcctggttgagaatcgaaagattcttaataaggcatccttccgatgctgacttctcaccgtccgttttccaataggagcgggcggtatgtttt

SEQ ID NO: 6946 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cctgcggccaggcctgcggggtgttgagaatcgaaagattcttaataaggcatccttccgatgctgacttctcaccgtccgttttccaataggagcgggcggtatgtttt

SEQ ID NO: 6947 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tccgccagaagaagcagcgccagttgagaatcgaaagattcttaataaggcatccttccgatgctgacttctcaccgtccgttttccaataggagcgggcggtatgtttt

SEQ ID NO: 6948 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 109^110: mod_base = OTHER; note = phosphorothioate bond
  modified_base 108^109: mod_base = OTHER; note = phosphorothioate bond
ttactgttttggttcattcccggttgagaatcgaaagattcttaataaggcatccttccgatgctgacttctcaccgtccgttttccaataggagcgggcggtatgtttt

SEQ ID NO: 6949 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tccactggcgctgcttcttctggttgagaatcgaaagattcttaataaggcatccttccgatgctgacttctcaccgtccgttttccaataggagcgggcggtatgtttt

SEQ ID NO: 6950 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agctgacaggtgggagttcctggttgagaatcgaaagattcttaataaggcatccttccgatgctgacttctcaccgtccgttttccaataggagcgggcggtatgtttt

SEQ ID NO: 6951 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggctgtattcgttatccacgtggttgagaatcgaaagattcttaataaggcatccttccgatgctgacttctcaccgtccgttttccaataggagcgggcggtatgtttt

SEQ ID NO: 6952 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tcgttatccacgtgggaggctggttgagaatcgaaagattcttaataaggcatccttccgatgctgacttctcaccgtccgttttccaataggagcgggcggtatgtttt

SEQ ID NO: 6953 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggaggctgtggggttctcagcagttgagaatcgaaagattcttaataaggcatccttccgatgctgacttctcaccgtccgttttccaataggagcgggcggtatgtttt

SEQ ID NO: 6954 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cctttctttccccagctctggagttgagaatcgaaagattcttaataaggcatccttccgatgctgacttctcaccgtccgttttccaataggagcgggcggtatgtttt

SEQ ID NO: 6955 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccgacagtgactatgatctgcagttgagaatcgaaagattcttaataaggcatccttccgatgctgacttctcaccgtccgttttccaataggagcgggcggtatgtttt

SEQ ID NO: 6956 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gactatgatctgcatggggctcgttgagaatcgaaagattcttaataaggcatccttccgatgctgacttctcaccgtccgttttccaataggagcgggcggtatgtttt

SEQ ID NO: 6957 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = um
  modified_base 110: mod_base = um
  modified_base 108: mod_base = um
  modified_base 109: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctttacagcctctgagccccatgttgagaatcgaaagattcttaataaggcatccttccgatgctgacttctcaccgtccgttttccaataggagcgggcggtatgtttt

SEQ ID NO: 6958 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atagtcactgtcggaggagttggttgagaatcgaaagattcttaataaggcatccttccgatgctgacttctcaccgtccgttttccaataggagcgggcggtatgtttt

SEQ ID NO: 6959 - DNA, 22 bp, unidentified
  misc_feature 1..22: note = Description of Unknown:MG3-6-CD5-target site-A1 sequence
  source 1..22: mol_type = other DNA
agaaggccagaaaccatgccca

SEQ ID NO: 6960 - DNA, 22 bp, unidentified
  misc_feature 1..22: note = Description of Unknown:MG3-6-CD5-target site-B1 sequence
  source 1..22: mol_type = other DNA
gtacaaggtggccagcggttgc

SEQ ID NO: 6961 - DNA, 22 bp, unidentified
  misc_feature 1..22: note = Description of Unknown:MG3-6-CD5-target site-C1 sequence
  source 1..22: mol_type = other DNA
ttctgacccccagatttccagg

SEQ ID NO: 6962 - DNA, 22 bp, unidentified
  misc_feature 1..22: note = Description of Unknown:MG3-6-CD5-target site-D1 sequence
  source 1..22: mol_type = other DNA
cacccgttccaactcgaagtgc

SEQ ID NO: 6963 - DNA, 22 bp, unidentified
  misc_feature 1..22: note = Description of Unknown:MG3-6-CD5-target site-E1 sequence
  source 1..22: mol_type = other DNA
actcgaagtgccagggccagct

SEQ ID NO: 6964 - DNA, 22 bp, unidentified
  misc_feature 1..22: note = Description of Unknown:MG3-6-CD5-target site-F1 sequence
  source 1..22: mol_type = other DNA
gcacatggtttgcagccagagc

SEQ ID NO: 6965 - DNA, 22 bp, unidentified
  misc_feature 1..22: note = Description of Unknown:MG3-6-CD5-target site-G1 sequence
  source 1..22: mol_type = other DNA
gggccggagctccaagcagtgg

SEQ ID NO: 6966 - DNA, 22 bp, unidentified
  misc_feature 1..22: note = Description of Unknown:MG3-6-CD5-target site-H1 sequence
  source 1..22: mol_type = other DNA
ctcaatcatctgctacggacaa

SEQ ID NO: 6967 - DNA, 22 bp, unidentified
  misc_feature 1..22: note = Description of Unknown:MG3-6-CD5-target site-A2 sequence
  source 1..22: mol_type = other DNA
cagaaatgacatgtgtcactct

SEQ ID NO: 6968 - DNA, 22 bp, unidentified
  misc_feature 1..22: note = Description of Unknown:MG3-6-CD5-target site-B2 sequence
  source 1..22: mol_type = other DNA
ggctggctagttacccacctaa

SEQ ID NO: 6969 - DNA, 22 bp, unidentified
  misc_feature 1..22: note = Description of Unknown:MG3-6-CD5-target site-C2 sequence
  source 1..22: mol_type = other DNA
gctagttacccacctaagcagg

SEQ ID NO: 6970 - DNA, 22 bp, unidentified
  misc_feature 1..22: note = Description of Unknown:MG3-6-CD5-target site-D2 sequence
  source 1..22: mol_type = other DNA
tgaggtgtgtaggtgacaagga

SEQ ID NO: 6971 - DNA, 22 bp, unidentified
  misc_feature 1..22: note = Description of Unknown:MG3-6-CD5-target site-E2 sequence
  source 1..22: mol_type = other DNA
gtgtaggtgacaaggaaggggc

SEQ ID NO: 6972 - DNA, 22 bp, unidentified
  misc_feature 1..22: note = Description of Unknown:MG3-6-CD5-target site-F2 sequence
  source 1..22: mol_type = other DNA
gcaccccacagttcagccgctg

SEQ ID NO: 6973 - DNA, 22 bp, unidentified
  misc_feature 1..22: note = Description of Unknown:MG3-6-CD5-target site-G2 sequence
  source 1..22: mol_type = other DNA
tggcagacttttgacgcttgac

SEQ ID NO: 6974 - DNA, 22 bp, unidentified
  misc_feature 1..22: note = Description of Unknown:MG3-6-CD5-target site-H2 sequence
  source 1..22: mol_type = other DNA
ccatgtgccatccgtccttgag

SEQ ID NO: 6975 - DNA, 22 bp, unidentified
  misc_feature 1..22: note = Description of Unknown:MG3-6-CD5-target site-A3 sequence
  source 1..22: mol_type = other DNA
ggtgagccttgcctggaaatct

SEQ ID NO: 6976 - DNA, 22 bp, unidentified
  misc_feature 1..22: note = Description of Unknown:MG3-6-CD5-target site-B3 sequence
  source 1..22: mol_type = other DNA
cagaagacaacacctccaacga

SEQ ID NO: 6977 - DNA, 22 bp, unidentified
  misc_feature 1..22: note = Description of Unknown:MG3-6-CD5-target site-C3 sequence
  source 1..22: mol_type = other DNA
caactccagagcccacaggtaa

SEQ ID NO: 6978 - DNA, 22 bp, unidentified
  misc_feature 1..22: note = Description of Unknown:MG3-6-CD5-target site-D3 sequence
  source 1..22: mol_type = other DNA
gggctctggagttgtggtgggc

SEQ ID NO: 6979 - DNA, 22 bp, unidentified
  misc_feature 1..22: note = Description of Unknown:MG3-6-CD5-target site-E3 sequence
  source 1..22: mol_type = other DNA
tgtcgttggaggtgttgtcttc

SEQ ID NO: 6980 - DNA, 22 bp, unidentified
  misc_feature 1..22: note = Description of Unknown:MG3-6-CD5-target site-F3 sequence
  source 1..22: mol_type = other DNA
ctctctcctctcctagctcctc

SEQ ID NO: 6981 - DNA, 22 bp, unidentified
  misc_feature 1..22: note = Description of Unknown:MG3-6-CD5-target site-G3 sequence
  source 1..22: mol_type = other DNA
gcctggggggtaccatcagcta

SEQ ID NO: 6982 - DNA, 22 bp, unidentified
  misc_feature 1..22: note = Description of Unknown:MG3-6-CD5-target site-H3 sequence
  source 1..22: mol_type = other DNA
ccatcagctatgaggcccagga

SEQ ID NO: 6983 - DNA, 22 bp, unidentified
  misc_feature 1..22: note = Description of Unknown:MG3-6-CD5-target site-A4 sequence
  source 1..22: mol_type = other DNA
ctatgaggcccaggacaagacc

SEQ ID NO: 6984 - DNA, 22 bp, unidentified
  misc_feature 1..22: note = Description of Unknown:MG3-6-CD5-target site-B4 sequence
  source 1..22: mol_type = other DNA
gctccttcttgaagcatctgcc

SEQ ID NO: 6985 - DNA, 22 bp, unidentified
  misc_feature 1..22: note = Description of Unknown:MG3-6-CD5-target site-C4 sequence
  source 1..22: mol_type = other DNA
agagactgaggcaggcagagcc

SEQ ID NO: 6986 - DNA, 22 bp, unidentified
  misc_feature 1..22: note = Description of Unknown:MG3-6-CD5-target site-D4 sequence
  source 1..22: mol_type = other DNA
accagcccttgccaatccaatg

SEQ ID NO: 6987 - DNA, 22 bp, unidentified
  misc_feature 1..22: note = Description of Unknown:MG3-6-CD5-target site-E4 sequence
  source 1..22: mol_type = other DNA
tgccctcctttgctcaggtaag

SEQ ID NO: 6988 - DNA, 22 bp, unidentified
  misc_feature 1..22: note = Description of Unknown:MG3-6-CD5-target site-F4 sequence
  source 1..22: mol_type = other DNA
ggcaagaactcggccacttttc

SEQ ID NO: 6989 - DNA, 22 bp, unidentified
  misc_feature 1..22: note = Description of Unknown:MG3-6-CD5-target site-G4 sequence
  source 1..22: mol_type = other DNA
ccagggaggtacagcttgagtt

SEQ ID NO: 6990 - DNA, 22 bp, unidentified
  misc_feature 1..22: note = Description of Unknown:MG3-6-CD5-target site-H4 sequence
  source 1..22: mol_type = other DNA
agcttgagttctggatcttcca

SEQ ID NO: 6991 - DNA, 22 bp, unidentified
  misc_feature 1..22: note = Description of Unknown:MG3-6-CD5-target site-A5 sequence
  source 1..22: mol_type = other DNA
ctggatcttccattggattggc

SEQ ID NO: 6992 - DNA, 22 bp, unidentified
  misc_feature 1..22: note = Description of Unknown:MG3-6-CD5-target site-B5 sequence
  source 1..22: mol_type = other DNA
ggctggtgttcccgtggctccc

SEQ ID NO: 6993 - DNA, 22 bp, unidentified
  misc_feature 1..22: note = Description of Unknown:MG3-6-CD5-target site-C5 sequence
  source 1..22: mol_type = other DNA
gttcccgtggctcccctgggtc

SEQ ID NO: 6994 - DNA, 22 bp, unidentified
  misc_feature 1..22: note = Description of Unknown:MG3-6-CD5-target site-D5 sequence
  source 1..22: mol_type = other DNA
tgcttcaagaaggagccacact

SEQ ID NO: 6995 - DNA, 22 bp, unidentified
  misc_feature 1..22: note = Description of Unknown:MG3-6-CD5-target site-E5 sequence
  source 1..22: mol_type = other DNA
aggttgttgcagaggaagttct

SEQ ID NO: 6996 - DNA, 22 bp, unidentified
  misc_feature 1..22: note = Description of Unknown:MG3-6-CD5-target site-F5 sequence
  source 1..22: mol_type = other DNA
tgcagaggaagttctccaggtc

SEQ ID NO: 6997 - DNA, 22 bp, unidentified
  misc_feature 1..22: note = Description of Unknown:MG3-6-CD5-target site-G5 sequence
  source 1..22: mol_type = other DNA
tctccaggtcctgggtcttgtc

SEQ ID NO: 6998 - DNA, 22 bp, unidentified
  misc_feature 1..22: note = Description of Unknown:MG3-6-CD5-target site-H5 sequence
  source 1..22: mol_type = other DNA
gcctcatagctgatggtacccc

SEQ ID NO: 6999 - DNA, 22 bp, unidentified
  misc_feature 1..22: note = Description of Unknown:MG3-6-CD5-target site-A6 sequence
  source 1..22: mol_type = other DNA
cacgccggcacagtgctggccg

SEQ ID NO: 7000 - DNA, 22 bp, unidentified
  misc_feature 1..22: note = Description of Unknown:MG3-6-CD5-target site-B6 sequence
  source 1..22: mol_type = other DNA
aaggcaccgtggaggtgcgcca

SEQ ID NO: 7001 - DNA, 22 bp, unidentified
  misc_feature 1..22: note = Description of Unknown:MG3-6-CD5-target site-C6 sequence
  source 1..22: mol_type = other DNA
gacgctggtgacccaacatccc

SEQ ID NO: 7002 - DNA, 22 bp, unidentified
  misc_feature 1..22: note = Description of Unknown:MG3-6-CD5-target site-D6 sequence
  source 1..22: mol_type = other DNA
ggacagaagagcccccgggatg

SEQ ID NO: 7003 - DNA, 22 bp, unidentified
  misc_feature 1..22: note = Description of Unknown:MG3-6-CD5-target site-E6 sequence
  source 1..22: mol_type = other DNA
tcctggctgaagagctgtcaca

SEQ ID NO: 7004 - DNA, 22 bp, unidentified
  misc_feature 1..22: note = Description of Unknown:MG3-6-CD5-target site-F6 sequence
  source 1..22: mol_type = other DNA
ccccaccagacggctctgcacc

SEQ ID NO: 7005 - DNA, 22 bp, unidentified
  misc_feature 1..22: note = Description of Unknown:MG3-6-CD5-target site-G6 sequence
  source 1..22: mol_type = other DNA
cccaggccaggatccaaacccc

SEQ ID NO: 7006 - DNA, 22 bp, unidentified
  misc_feature 1..22: note = Description of Unknown:MG3-6-CD5-target site-H6 sequence
  source 1..22: mol_type = other DNA
ttcactagcttcttgtaggcaa

SEQ ID NO: 7007 - DNA, 22 bp, unidentified
  misc_feature 1..22: note = Description of Unknown:MG3-6-CD5-target site-A7 sequence
  source 1..22: mol_type = other DNA
ccagcagcaccaccaggagcac

SEQ ID NO: 7008 - DNA, 22 bp, unidentified
  misc_feature 1..22: note = Description of Unknown:MG3-6-CD5-target site-B7 sequence
  source 1..22: mol_type = other DNA
atgcttgccaccgtgcctgcgg

SEQ ID NO: 7009 - DNA, 22 bp, unidentified
  misc_feature 1..22: note = Description of Unknown:MG3-6-CD5-target site-C7 sequence
  source 1..22: mol_type = other DNA
accgtgcctgcggccaggcctg

SEQ ID NO: 7010 - DNA, 22 bp, unidentified
  misc_feature 1..22: note = Description of Unknown:MG3-6-CD5-target site-D7 sequence
  source 1..22: mol_type = other DNA
cctgcggccaggcctgcggggt

SEQ ID NO: 7011 - DNA, 22 bp, unidentified
  misc_feature 1..22: note = Description of Unknown:MG3-6-CD5-target site-E7 sequence
  source 1..22: mol_type = other DNA
tccgccagaagaagcagcgcca

SEQ ID NO: 7012 - DNA, 22 bp, unidentified
  misc_feature 1..22: note = Description of Unknown:MG3-6-CD5-target site-F7 sequence
  source 1..22: mol_type = other DNA
ttactgttttggttcattcccg

SEQ ID NO: 7013 - DNA, 22 bp, unidentified
  misc_feature 1..22: note = Description of Unknown:MG3-6-CD5-target site-G7 sequence
  source 1..22: mol_type = other DNA
tccactggcgctgcttcttctg

SEQ ID NO: 7014 - DNA, 22 bp, unidentified
  misc_feature 1..22: note = Description of Unknown:MG3-6-CD5-target site-H7 sequence
  source 1..22: mol_type = other DNA
agctgacaggtgggagttcctg

SEQ ID NO: 7015 - DNA, 22 bp, unidentified
  misc_feature 1..22: note = Description of Unknown:MG3-6-CD5-target site-A8 sequence
  source 1..22: mol_type = other DNA
ggctgtattcgttatccacgtg

SEQ ID NO: 7016 - DNA, 22 bp, unidentified
  misc_feature 1..22: note = Description of Unknown:MG3-6-CD5-target site-B8 sequence
  source 1..22: mol_type = other DNA
tcgttatccacgtgggaggctg

SEQ ID NO: 7017 - DNA, 22 bp, unidentified
  misc_feature 1..22: note = Description of Unknown:MG3-6-CD5-target site-C8 sequence
  source 1..22: mol_type = other DNA
ggaggctgtggggttctcagca

SEQ ID NO: 7018 - DNA, 22 bp, unidentified
  misc_feature 1..22: note = Description of Unknown:MG3-6-CD5-target site-D8 sequence
  source 1..22: mol_type = other DNA
cctttctttccccagctctgga

SEQ ID NO: 7019 - DNA, 22 bp, unidentified
  misc_feature 1..22: note = Description of Unknown:MG3-6-CD5-target site-E8 sequence
  source 1..22: mol_type = other DNA
ccgacagtgactatgatctgca

SEQ ID NO: 7020 - DNA, 22 bp, unidentified
  misc_feature 1..22: note = Description of Unknown:MG3-6-CD5-target site-F8 sequence
  source 1..22: mol_type = other DNA
gactatgatctgcatggggctc

SEQ ID NO: 7021 - DNA, 22 bp, unidentified
  misc_feature 1..22: note = Description of Unknown:MG3-6-CD5-target site-G8 sequence
  source 1..22: mol_type = other DNA
ctttacagcctctgagccccat

SEQ ID NO: 7022 - DNA, 22 bp, unidentified
  misc_feature 1..22: note = Description of Unknown:MG3-6-CD5-target site-H8 sequence
  source 1..22: mol_type = other DNA
atagtcactgtcggaggagttg

SEQ ID NO: 7023 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctgatgagtggtttccctgagcgttgagaatcgaaagattcttaataaggcatccttccgatgctgacttctcaccgtccgttttccaataggagcgggcggtatgtttt

SEQ ID NO: 7024 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttagatgctcagagtgtgtgcagttgagaatcgaaagattcttaataaggcatccttccgatgctgacttctcaccgtccgttttccaataggagcgggcggtatgtttt

SEQ ID NO: 7025 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtgtgcacaaggctggcacgccgttgagaatcgaaagattcttaataaggcatccttccgatgctgacttctcaccgtccgttttccaataggagcgggcggtatgtttt

SEQ ID NO: 7026 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gagacaagcctatcaacacctagttgagaatcgaaagattcttaataaggcatccttccgatgctgacttctcaccgtccgttttccaataggagcgggcggtatgtttt

SEQ ID NO: 7027 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
accaccagtcttgtaggtgttggttgagaatcgaaagattcttaataaggcatccttccgatgctgacttctcaccgtccgttttccaataggagcgggcggtatgtttt

SEQ ID NO: 7028 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cttgtctctgttccacctttcagttgagaatcgaaagattcttaataaggcatccttccgatgctgacttctcaccgtccgttttccaataggagcgggcggtatgtttt

SEQ ID NO: 7029 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = 108^109
  modified_base 109^110: mod_base = OTHER; note = phosphorothioate bond
agtagactgttagtgccatgaggttgagaatcgaaagattcttaataaggcatccttccgatgctgacttctcaccgtccgttttccaataggagcgggcggtatgtttt

SEQ ID NO: 7030 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttacaggttcttacgtctgttggttgagaatcgaaagattcttaataaggcatccttccgatgctgacttctcaccgtccgttttccaataggagcgggcggtatgtttt

SEQ ID NO: 7031 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
caagtgactgacatcaactccagttgagaatcgaaagattcttaataaggcatccttccgatgctgacttctcaccgtccgttttccaataggagcgggcggtatgtttt

SEQ ID NO: 7032 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
actccaagggattggaattgaggttgagaatcgaaagattcttaataaggcatccttccgatgctgacttctcaccgtccgttttccaataggagcgggcggtatgtttt

SEQ ID NO: 7033 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgaggaagactgttactacagtgttgagaatcgaaagattcttaataaggcatccttccgatgctgacttctcaccgtccgttttccaataggagcgggcggtatgtttt

SEQ ID NO: 7034 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tacagttgagactcagaacttggttgagaatcgaaagattcttaataaggcatccttccgatgctgacttctcaccgtccgttttccaataggagcgggcggtatgtttt

SEQ ID NO: 7035 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tttgtgtaacatacctggaggagttgagaatcgaaagattcttaataaggcatccttccgatgctgacttctcaccgtccgttttccaataggagcgggcggtatgtttt

SEQ ID NO: 7036 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tggcagaattggccatcatgatgttgagaatcgaaagattcttaataaggcatccttccgatgctgacttctcaccgtccgttttccaataggagcgggcggtatgtttt

SEQ ID NO: 7037 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttgggcaggtgaaaggaaagctgttgagaatcgaaagattcttaataaggcatccttccgatgctgacttctcaccgtccgttttccaataggagcgggcggtatgtttt

SEQ ID NO: 7038 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctgcacagtcaatggggatgaagttgagaatcgaaagattcttaataaggcatccttccgatgctgacttctcaccgtccgttttccaataggagcgggcggtatgtttt

SEQ ID NO: 7039 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ttttcttccaaatgcagaagatgttgagaatcgaaagattcttaataaggcatccttccgatgctgacttctcaccgtccgttttccaataggagcgggcggtatgtttt

SEQ ID NO: 7040 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atcttctgcatttggaagaaaagttgagaatcgaaagattcttaataaggcatccttccgatgctgacttctcaccgtccgttttccaataggagcgggcggtatgtttt

SEQ ID NO: 7041 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tagaagtggaaataaactgcacgttgagaatcgaaagattcttaataaggcatccttccgatgctgacttctcaccgtccgttttccaataggagcgggcggtatgtttt

SEQ ID NO: 7042 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aagactaaaacttacttggtgcgttgagaatcgaaagattcttaataaggcatccttccgatgctgacttctcaccgtccgttttccaataggagcgggcggtatgtttt

SEQ ID NO: 7043 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtttacatctgcacttggtattgttgagaatcgaaagattcttaataaggcatccttccgatgctgacttctcaccgtccgttttccaataggagcgggcggtatgtttt

SEQ ID NO: 7044 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aagaagacaaagccaccccaaggttgagaatcgaaagattcttaataaggcatccttccgatgctgacttctcaccgtccgttttccaataggagcgggcggtatgtttt

SEQ ID NO: 7045 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acaaagccaccccaagttagatgttgagaatcgaaagattcttaataaggcatccttccgatgctgacttctcaccgtccgttttccaataggagcgggcggtatgtttt

SEQ ID NO: 7046 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccccaagttagatctggatcctgttgagaatcgaaagattcttaataaggcatccttccgatgctgacttctcaccgtccgttttccaataggagcgggcggtatgtttt

SEQ ID NO: 7047 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cagaaagcacagaaaggaaaacgttgagaatcgaaagattcttaataaggcatccttccgatgctgacttctcaccgtccgttttccaataggagcgggcggtatgtttt

SEQ ID NO: 7048 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aatacctacaggatttaaagttgttgagaatcgaaagattcttaataaggcatccttccgatgctgacttctcaccgtccgttttccaataggagcgggcggtatgtttt

SEQ ID NO: 7049 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cagtggcaataaatttatctgggttgagaatcgaaagattcttaataaggcatccttccgatgctgacttctcaccgtccgttttccaataggagcgggcggtatgtttt

SEQ ID NO: 7050 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agtcatgacactaagtcaagttgttgagaatcgaaagattcttaataaggcatccttccgatgctgacttctcaccgtccgttttccaataggagcgggcggtatgtttt

SEQ ID NO: 7051 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtgtcaatgaagccaaaatagagttgagaatcgaaagattcttaataaggcatccttccgatgctgacttctcaccgtccgttttccaataggagcgggcggtatgtttt

SEQ ID NO: 7052 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agaagcgtatgacacattgattgttgagaatcgaaagattcttaataaggcatccttccgatgctgacttctcaccgtccgttttccaataggagcgggcggtatgtttt

SEQ ID NO: 7053 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tttgtactcttgcagagaaaatgttgagaatcgaaagattcttaataaggcatccttccgatgctgacttctcaccgtccgttttccaataggagcgggcggtatgtttt

SEQ ID NO: 7054 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtttttcactctagaccaagctgttgagaatcgaaagattcttaataaggcatccttccgatgctgacttctcaccgtccgttttccaataggagcgggcggtatgtttt

SEQ ID NO: 7055 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgaattttctctgcaagagtacgttgagaatcgaaagattcttaataaggcatccttccgatgctgacttctcaccgtccgttttccaataggagcgggcggtatgtttt

SEQ ID NO: 7056 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agagtacaaagattggctttttgttgagaatcgaaagattcttaataaggcatccttccgatgctgacttctcaccgtccgttttccaataggagcgggcggtatgtttt

SEQ ID NO: 7057 - DNA, 22 bp, unidentified
  misc_feature 1..22: note = Description of Unknown:MG3-6-FAS-target site-A1 sequence
  source 1..22: mol_type = other DNA
ctgatgagtggtttccctgagc

SEQ ID NO: 7058 - DNA, 22 bp, unidentified
  misc_feature 1..22: note = Description of Unknown:MG3-6-FAS-target site-B1 sequence
  source 1..22: mol_type = other DNA
ttagatgctcagagtgtgtgca

SEQ ID NO: 7059 - DNA, 22 bp, unidentified
  misc_feature 1..22: note = Description of Unknown:MG3-6-FAS-target site-C1 sequence
  source 1..22: mol_type = other DNA
gtgtgcacaaggctggcacgcc

SEQ ID NO: 7060 - DNA, 22 bp, unidentified
  misc_feature 1..22: note = Description of Unknown:MG3-6-FAS-target site-D1 sequence
  source 1..22: mol_type = other DNA
gagacaagcctatcaacaccta

SEQ ID NO: 7061 - DNA, 22 bp, unidentified
  misc_feature 1..22: note = Description of Unknown:MG3-6-FAS-target site-E1 sequence
  source 1..22: mol_type = other DNA
accaccagtcttgtaggtgttg

SEQ ID NO: 7062 - DNA, 22 bp, unidentified
  misc_feature 1..22: note = Description of Unknown:MG3-6-FAS-target site-F1 sequence
  source 1..22: mol_type = other DNA
cttgtctctgttccacctttca

SEQ ID NO: 7063 - DNA, 22 bp, unidentified
  misc_feature 1..22: note = Description of Unknown:MG3-6-FAS-target site-G1 sequence
  source 1..22: mol_type = other DNA
agtagactgttagtgccatgag

SEQ ID NO: 7064 - DNA, 22 bp, unidentified
  misc_feature 1..22: note = Description of Unknown:MG3-6-FAS-target site-H1 sequence
  source 1..22: mol_type = other DNA
ttacaggttcttacgtctgttg

SEQ ID NO: 7065 - DNA, 22 bp, unidentified
  misc_feature 1..22: note = Description of Unknown:MG3-6-FAS-target site-A2 sequence
  source 1..22: mol_type = other DNA
caagtgactgacatcaactcca

SEQ ID NO: 7066 - DNA, 22 bp, unidentified
  misc_feature 1..22: note = Description of Unknown:MG3-6-FAS-target site-B2 sequence
  source 1..22: mol_type = other DNA
actccaagggattggaattgag

SEQ ID NO: 7067 - DNA, 22 bp, unidentified
  misc_feature 1..22: note = Description of Unknown:MG3-6-FAS-target site-C2 sequence
  source 1..22: mol_type = other DNA
tgaggaagactgttactacagt

SEQ ID NO: 7068 - DNA, 22 bp, unidentified
  misc_feature 1..22: note = Description of Unknown:MG3-6-FAS-target site-D2 sequence
  source 1..22: mol_type = other DNA
tacagttgagactcagaacttg

SEQ ID NO: 7069 - DNA, 22 bp, unidentified
  misc_feature 1..22: note = Description of Unknown:MG3-6-FAS-target site-E2 sequence
  source 1..22: mol_type = other DNA
tttgtgtaacatacctggagga

SEQ ID NO: 7070 - DNA, 22 bp, unidentified
  misc_feature 1..22: note = Description of Unknown:MG3-6-FAS-target site-F2 sequence
  source 1..22: mol_type = other DNA
tggcagaattggccatcatgat

SEQ ID NO: 7071 - DNA, 22 bp, unidentified
  misc_feature 1..22: note = Description of Unknown:MG3-6-FAS-target site-G2 sequence
  source 1..22: mol_type = other DNA
ttgggcaggtgaaaggaaagct

SEQ ID NO: 7072 - DNA, 22 bp, unidentified
  misc_feature 1..22: note = Description of Unknown:MG3-6-FAS-target site-H2 sequence
  source 1..22: mol_type = other DNA
ctgcacagtcaatggggatgaa

SEQ ID NO: 7073 - DNA, 22 bp, unidentified
  misc_feature 1..22: note = Description of Unknown:MG3-6-FAS-target site-A3 sequence
  source 1..22: mol_type = other DNA
ttttcttccaaatgcagaagat

SEQ ID NO: 7074 - DNA, 22 bp, unidentified
  misc_feature 1..22: note = Description of Unknown:MG3-6-FAS-target site-B3 sequence
  source 1..22: mol_type = other DNA
atcttctgcatttggaagaaaa

SEQ ID NO: 7075 - DNA, 22 bp, unidentified
  misc_feature 1..22: note = Description of Unknown:MG3-6-FAS-target site-C3 sequence
  source 1..22: mol_type = other DNA
tagaagtggaaataaactgcac

SEQ ID NO: 7076 - DNA, 22 bp, unidentified
  misc_feature 1..22: note = Description of Unknown:MG3-6-FAS-target site-D3 sequence
  source 1..22: mol_type = other DNA
aagactaaaacttacttggtgc

SEQ ID NO: 7077 - DNA, 22 bp, unidentified
  misc_feature 1..22: note = Description of Unknown:MG3-6-FAS-target site-E3 sequence
  source 1..22: mol_type = other DNA
gtttacatctgcacttggtatt

SEQ ID NO: 7078 - DNA, 22 bp, unidentified
  misc_feature 1..22: note = Description of Unknown:MG3-6-FAS-target site-F3 sequence
  source 1..22: mol_type = other DNA
aagaagacaaagccaccccaag

SEQ ID NO: 7079 - DNA, 22 bp, unidentified
  misc_feature 1..22: note = Description of Unknown:MG3-6-FAS-target site-G3 sequence
  source 1..22: mol_type = other DNA
acaaagccaccccaagttagat

SEQ ID NO: 7080 - DNA, 22 bp, unidentified
  misc_feature 1..22: note = Description of Unknown:MG3-6-FAS-target site-H3 sequence
  source 1..22: mol_type = other DNA
ccccaagttagatctggatcct

SEQ ID NO: 7081 - DNA, 22 bp, unidentified
  misc_feature 1..22: note = Description of Unknown:MG3-6-FAS-target site-A4 sequence
  source 1..22: mol_type = other DNA
cagaaagcacagaaaggaaaac

SEQ ID NO: 7082 - DNA, 22 bp, unidentified
  misc_feature 1..22: note = Description of Unknown:MG3-6-FAS-target site-B4 sequence
  source 1..22: mol_type = other DNA
aatacctacaggatttaaagtt

SEQ ID NO: 7083 - DNA, 22 bp, unidentified
  misc_feature 1..22: note = Description of Unknown:MG3-6-FAS-target site-C4 sequence
  source 1..22: mol_type = other DNA
cagtggcaataaatttatctgg

SEQ ID NO: 7084 - DNA, 22 bp, unidentified
  misc_feature 1..22: note = Description of Unknown:MG3-6-FAS-target site-D4 sequence
  source 1..22: mol_type = other DNA
agtcatgacactaagtcaagtt

SEQ ID NO: 7085 - DNA, 22 bp, unidentified
  misc_feature 1..22: note = Description of Unknown:MG3-6-FAS-target site-E4 sequence
  source 1..22: mol_type = other DNA
gtgtcaatgaagccaaaataga

SEQ ID NO: 7086 - DNA, 22 bp, unidentified
  misc_feature 1..22: note = Description of Unknown:MG3-6-FAS-target site-F4 sequence
  source 1..22: mol_type = other DNA
agaagcgtatgacacattgatt

SEQ ID NO: 7087 - DNA, 22 bp, unidentified
  misc_feature 1..22: note = Description of Unknown:MG3-6-FAS-target site-G4 sequence
  source 1..22: mol_type = other DNA
tttgtactcttgcagagaaaat

SEQ ID NO: 7088 - DNA, 22 bp, unidentified
  misc_feature 1..22: note = Description of Unknown:MG3-6-FAS-target site-H4 sequence
  source 1..22: mol_type = other DNA
gtttttcactctagaccaagct

SEQ ID NO: 7089 - DNA, 22 bp, unidentified
  misc_feature 1..22: note = Description of Unknown:MG3-6-FAS-target site-A5 sequence
  source 1..22: mol_type = other DNA
tgaattttctctgcaagagtac

SEQ ID NO: 7090 - DNA, 22 bp, unidentified
  misc_feature 1..22: note = Description of Unknown:MG3-6-FAS-target site-B5 sequence
  source 1..22: mol_type = other DNA
agagtacaaagattggcttttt

SEQ ID NO: 7091 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggtggccaaggaagccggtcaggttgagaatcgaaagattcttaataaggcatccttccgatgctgacttctcaccgtccgttttccaataggagcgggcggtatgtttt

SEQ ID NO: 7092 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gggccaagagcagtgtccatccgttgagaatcgaaagattcttaataaggcatccttccgatgctgacttctcaccgtccgttttccaataggagcgggcggtatgtttt

SEQ ID NO: 7093 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = OTHER; note = phosphorothioate bond
  modified_base 110: mod_base = OTHER; note = phosphorothioate bond
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggccctcggagtgcccagccacgttgagaatcgaaagattcttaataaggcatccttccgatgctgacttctcaccgtccgttttccaataggagcgggcggtatgtttt

SEQ ID NO: 7094 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggcctcagtggctgggcactccgttgagaatcgaaagattcttaataaggcatccttccgatgctgacttctcaccgtccgttttccaataggagcgggcggtatgtttt

SEQ ID NO: 7095 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gggcacctcatcccccgcccgcgttgagaatcgaaagattcttaataaggcatccttccgatgctgacttctcaccgtccgttttccaataggagcgggcggtatgtttt

SEQ ID NO: 7096 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 109^110: mod_base = OTHER; note = phosphorothioate bond
  modified_base 108^109: mod_base = OTHER; note = phosphorothioate bond
ctgctcagggacacagggcacggttgagaatcgaaagattcttaataaggcatccttccgatgctgacttctcaccgtccgttttccaataggagcgggcggtatgtttt

SEQ ID NO: 7097 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggacacagggcacggggggctcgttgagaatcgaaagattcttaataaggcatccttccgatgctgacttctcaccgtccgttttccaataggagcgggcggtatgtttt

SEQ ID NO: 7098 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agctggatttccagtggcgagagttgagaatcgaaagattcttaataaggcatccttccgatgctgacttctcaccgtccgttttccaataggagcgggcggtatgtttt

SEQ ID NO: 7099 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gttctctgtggactatggggaggttgagaatcgaaagattcttaataaggcatccttccgatgctgacttctcaccgtccgttttccaataggagcgggcggtatgtttt

SEQ ID NO: 7100 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctcagccgtgcctgtgttctctgttgagaatcgaaagattcttaataaggcatccttccgatgctgacttctcaccgtccgttttccaataggagcgggcggtatgtttt

SEQ ID NO: 7101 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acagagaacacaggcacggctggttgagaatcgaaagattcttaataaggcatccttccgatgctgacttctcaccgtccgttttccaataggagcgggcggtatgtttt

SEQ ID NO: 7102 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gggtcctggccgtcatctgctcgttgagaatcgaaagattcttaataaggcatccttccgatgctgacttctcaccgtccgttttccaataggagcgggcggtatgtttt

SEQ ID NO: 7103 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cggcccgggagcagatgacggcgttgagaatcgaaagattcttaataaggcatccttccgatgctgacttctcaccgtccgttttccaataggagcgggcggtatgtttt

SEQ ID NO: 7104 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gggagcagatgacggccaggacgttgagaatcgaaagattcttaataaggcatccttccgatgctgacttctcaccgtccgttttccaataggagcgggcggtatgtttt

SEQ ID NO: 7105 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgggcagcctggtgctgctagtgttgagaatcgaaagattcttaataaggcatccttccgatgctgacttctcaccgtccgttttccaataggagcgggcggtatgtttt

SEQ ID NO: 7106 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gccaggacccagactagcagcagttgagaatcgaaagattcttaataaggcatccttccgatgctgacttctcaccgtccgttttccaataggagcgggcggtatgtttt

SEQ ID NO: 7107 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
actagcagcaccaggctgcccagttgagaatcgaaagattcttaataaggcatccttccgatgctgacttctcaccgtccgttttccaataggagcgggcggtatgtttt

SEQ ID NO: 7108 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggccgcccacgacaccaaccacgttgagaatcgaaagattcttaataaggcatccttccgatgctgacttctcaccgtccgttttccaataggagcgggcggtatgtttt

SEQ ID NO: 7109 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
aactggccggctggcctgggtggttgagaatcgaaagattcttaataaggcatccttccgatgctgacttctcaccgtccgttttccaataggagcgggcggtatgtttt

SEQ ID NO: 7110 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
acagcccaccccagcccctcacgttgagaatcgaaagattcttaataaggcatccttccgatgctgacttctcaccgtccgttttccaataggagcgggcggtatgtttt

SEQ ID NO: 7111 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctggcctgggtgaggggctggggttgagaatcgaaagattcttaataaggcatccttccgatgctgacttctcaccgtccgttttccaataggagcgggcggtatgtttt

SEQ ID NO: 7112 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cctgtcaccctgagctctgcccgttgagaatcgaaagattcttaataaggcatccttccgatgctgacttctcaccgtccgttttccaataggagcgggcggtatgtttt

SEQ ID NO: 7113 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggctctctttgatctgcgccttgttgagaatcgaaagattcttaataaggcatccttccgatgctgacttctcaccgtccgttttccaataggagcgggcggtatgtttt

SEQ ID NO: 7114 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ccatctccctggcccccaaggcgttgagaatcgaaagattcttaataaggcatccttccgatgctgacttctcaccgtccgttttccaataggagcgggcggtatgtttt

SEQ ID NO: 7115 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atgacagcggcacctacctctggttgagaatcgaaagattcttaataaggcatccttccgatgctgacttctcaccgtccgttttccaataggagcgggcggtatgtttt

SEQ ID NO: 7116 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ggtaggtgccgctgtcattgcggttgagaatcgaaagattcttaataaggcatccttccgatgctgacttctcaccgtccgttttccaataggagcgggcggtatgtttt

SEQ ID NO: 7117 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = um
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gtgacttccacatgagcgtggtgttgagaatcgaaagattcttaataaggcatccttccgatgctgacttctcaccgtccgttttccaataggagcgggcggtatgtttt

SEQ ID NO: 7118 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gacacggaagcggcagtcctgggttgagaatcgaaagattcttaataaggcatccttccgatgctgacttctcaccgtccgttttccaataggagcgggcggtatgtttt

SEQ ID NO: 7119 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
cgaggaccgcagccagcccggcgttgagaatcgaaagattcttaataaggcatccttccgatgctgacttctcaccgtccgttttccaataggagcgggcggtatgtttt

SEQ ID NO: 7120 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 109^110: mod_base = OTHER; note = phosphorothioate bond
  modified_base 108^109: mod_base = OTHER; note = phosphorothioate bond
ggacaagctggccgccttccccgttgagaatcgaaagattcttaataaggcatccttccgatgctgacttctcaccgtccgttttccaataggagcgggcggtatgtttt

SEQ ID NO: 7121 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gccagcttgtccgtctggttgcgttgagaatcgaaagattcttaataaggcatccttccgatgctgacttctcaccgtccgttttccaataggagcgggcggtatgtttt

SEQ ID NO: 7122 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tgtccccttcggtcaccacgaggttgagaatcgaaagattcttaataaggcatccttccgatgctgacttctcaccgtccgttttccaataggagcgggcggtatgtttt

SEQ ID NO: 7123 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agcagggctggggagaaggtgggttgagaatcgaaagattcttaataaggcatccttccgatgctgacttctcaccgtccgttttccaataggagcgggcggtatgtttt

SEQ ID NO: 7124 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tggggagaaggtgggggggttcgttgagaatcgaaagattcttaataaggcatccttccgatgctgacttctcaccgtccgttttccaataggagcgggcggtatgtttt

SEQ ID NO: 7125 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
ctccatctctcagactccccaggttgagaatcgaaagattcttaataaggcatccttccgatgctgacttctcaccgtccgttttccaataggagcgggcggtatgtttt

SEQ ID NO: 7126 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gccaggatggttcttaggtagggttgagaatcgaaagattcttaataaggcatccttccgatgctgacttctcaccgtccgttttccaataggagcgggcggtatgtttt

SEQ ID NO: 7127 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 108^109: mod_base = OTHER; note = phosphorothioate bond
  modified_base 109^110: mod_base = OTHER; note = phosphorothioate bond
  modified_base 107^108: mod_base = OTHER; note = phosphorothioate bond
agtcgtctgggcggtgctacaagttgagaatcgaaagattcttaataaggcatccttccgatgctgacttctcaccgtccgttttccaataggagcgggcggtatgtttt

SEQ ID NO: 7128 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = OTHER; note = 2-O-methyladenosine
  modified_base 108: mod_base = um
  modified_base 1^2: mod_base = OTHER; note = phosphorothioate bond
  modified_base 109: mod_base = um
  modified_base 110: mod_base = um
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agacgactggccagggcgcctggttgagaatcgaaagattcttaataaggcatccttccgatgctgacttctcaccgtccgttttccaataggagcgggcggtatgtttt

SEQ ID NO: 7129 - DNA, 22 bp, unidentified
  misc_feature 1..22: note = Description of Unknown:MG3-6-PD-1-target site-A1 sequence
  source 1..22: mol_type = other DNA
ggtggccaaggaagccggtcag

SEQ ID NO: 7130 - DNA, 22 bp, unidentified
  misc_feature 1..22: note = Description of Unknown:MG3-6-PD-1-target site-B1 sequence
  source 1..22: mol_type = other DNA
gggccaagagcagtgtccatcc

SEQ ID NO: 7131 - DNA, 22 bp, unidentified
  misc_feature 1..22: note = Description of Unknown:MG3-6-PD-1-target site-C1 sequence
  source 1..22: mol_type = other DNA
ggccctcggagtgcccagccac

SEQ ID NO: 7132 - DNA, 22 bp, unidentified
  misc_feature 1..22: note = Description of Unknown:MG3-6-PD-1-target site-D1 sequence
  source 1..22: mol_type = other DNA
ggcctcagtggctgggcactcc

SEQ ID NO: 7133 - DNA, 22 bp, unidentified
  misc_feature 1..22: note = Description of Unknown:MG3-6-PD-1-target site-E1 sequence
  source 1..22: mol_type = other DNA
gggcacctcatcccccgcccgc

SEQ ID NO: 7134 - DNA, 22 bp, unidentified
  misc_feature 1..22: note = Description of Unknown:MG3-6-PD-1-target site-F1 sequence
  source 1..22: mol_type = other DNA
ggacacagggcacggggggctc

SEQ ID NO: 7135 - DNA, 22 bp, unidentified
  misc_feature 1..22: note = Description of Unknown:MG3-6-PD-1-target site-G1 sequence
  source 1..22: mol_type = other DNA
ggacacagggcacggggggctc

SEQ ID NO: 7136 - DNA, 22 bp, unidentified
  misc_feature 1..22: note = Description of Unknown:MG3-6-PD-1-target site-H1 sequence
  source 1..22: mol_type = other DNA
agctggatttccagtggcgaga

SEQ ID NO: 7137 - DNA, 22 bp, unidentified
  misc_feature 1..22: note = Description of Unknown:MG3-6-PD-1-target site-A2 sequence
  source 1..22: mol_type = other DNA
gttctctgtggactatggggag

SEQ ID NO: 7138 - DNA, 22 bp, unidentified
  misc_feature 1..22: note = Description of Unknown:MG3-6-PD-1-target site-B2 sequence
  source 1..22: mol_type = other DNA
ctcagccgtgcctgtgttctct

SEQ ID NO: 7139 - DNA, 22 bp, unidentified
  misc_feature 1..22: note = Description of Unknown:MG3-6-PD-1-target site-C2 sequence
  source 1..22: mol_type = other DNA
acagagaacacaggcacggctg

SEQ ID NO: 7140 - DNA, 22 bp, unidentified
  misc_feature 1..22: note = Description of Unknown:MG3-6-PD-1-target site-D2 sequence
  source 1..22: mol_type = other DNA
gggtcctggccgtcatctgctc

SEQ ID NO: 7141 - DNA, 22 bp, unidentified
  misc_feature 1..22: note = Description of Unknown:MG3-6-PD-1-target site-E2 sequence
  source 1..22: mol_type = other DNA
cggcccgggagcagatgacggc

SEQ ID NO: 7142 - DNA, 22 bp, unidentified
  misc_feature 1..22: note = Description of Unknown:MG3-6-PD-1-target site-F2 sequence
  source 1..22: mol_type = other DNA
gggagcagatgacggccaggac

SEQ ID NO: 7143 - DNA, 22 bp, unidentified
  misc_feature 1..22: note = Description of Unknown:MG3-6-PD-1-target site-G2 sequence
  source 1..22: mol_type = other DNA
tgggcagcctggtgctgctagt

SEQ ID NO: 7144 - DNA, 22 bp, unidentified
  misc_feature 1..22: note = Description of Unknown:MG3-6-PD-1-target site-H2 sequence
  source 1..22: mol_type = other DNA
gccaggacccagactagcagca

SEQ ID NO: 7145 - DNA, 22 bp, unidentified
  misc_feature 1..22: note = Description of Unknown:MG3-6-PD-1-target site-A3 sequence
  source 1..22: mol_type = other DNA
actagcagcaccaggctgccca

SEQ ID NO: 7146 - DNA, 22 bp, unidentified
  misc_feature 1..22: note = Description of Unknown:MG3-6-PD-1-target site-B3 sequence
  source 1..22: mol_type = other DNA
ggccgcccacgacaccaaccac

SEQ ID NO: 7147 - DNA, 22 bp, unidentified
  misc_feature 1..22: note = Description of Unknown:MG3-6-PD-1-target site-C3 sequence
  source 1..22: mol_type = other DNA
aactggccggctggcctgggtg

SEQ ID NO: 7148 - DNA, 22 bp, unidentified
  misc_feature 1..22: note = Description of Unknown:MG3-6-PD-1-target site-D3 sequence
  source 1..22: mol_type = other DNA
acagcccaccccagcccctcac

SEQ ID NO: 7149 - DNA, 22 bp, unidentified
  misc_feature 1..22: note = Description of Unknown:MG3-6-PD-1-target site-E3 sequence
  source 1..22: mol_type = other DNA
ctggcctgggtgaggggctggg

SEQ ID NO: 7150 - DNA, 22 bp, unidentified
  misc_feature 1..22: note = Description of Unknown:MG3-6-PD-1-target site-F3 sequence
  source 1..22: mol_type = other DNA
cctgtcaccctgagctctgccc

SEQ ID NO: 7151 - DNA, 22 bp, unidentified
  misc_feature 1..22: note = Description of Unknown:MG3-6-PD-1-target site-G3 sequence
  source 1..22: mol_type = other DNA
ggctctctttgatctgcgcctt

SEQ ID NO: 7152 - DNA, 22 bp, unidentified
  misc_feature 1..22: note = Description of Unknown:MG3-6-PD-1-target site-H3 sequence
  source 1..22: mol_type = other DNA
ccatctccctggcccccaaggc

SEQ ID NO: 7153 - DNA, 22 bp, unidentified
  misc_feature 1..22: note = Description of Unknown:MG3-6-PD-1-target site-A4 sequence
  source 1..22: mol_type = other DNA
atgacagcggcacctacctctg

SEQ ID NO: 7154 - DNA, 22 bp, unidentified
  misc_feature 1..22: note = Description of Unknown:MG3-6-PD-1-target site-B4 sequence
  source 1..22: mol_type = other DNA
ggtaggtgccgctgtcattgcg

SEQ ID NO: 7155 - DNA, 22 bp, unidentified
  misc_feature 1..22: note = Description of Unknown:MG3-6-PD-1-target site-C4 sequence
  source 1..22: mol_type = other DNA
gtgacttccacatgagcgtggt

SEQ ID NO: 7156 - DNA, 22 bp, unidentified
  misc_feature 1..22: note = Description of Unknown:MG3-6-PD-1-target site-D4 sequence
  source 1..22: mol_type = other DNA
gacacggaagcggcagtcctgg

SEQ ID NO: 7157 - DNA, 22 bp, unidentified
  misc_feature 1..22: note = Description of Unknown:MG3-6-PD-1-target site-E4 sequence
  source 1..22: mol_type = other DNA
cgaggaccgcagccagcccggc

SEQ ID NO: 7158 - DNA, 22 bp, unidentified
  misc_feature 1..22: note = Description of Unknown:MG3-6-PD-1-target site-F4 sequence
  source 1..22: mol_type = other DNA
ggacaagctggccgccttcccc

SEQ ID NO: 7159 - DNA, 22 bp, unidentified
  misc_feature 1..22: note = Description of Unknown:MG3-6-PD-1-target site-G4 sequence
  source 1..22: mol_type = other DNA
gccagcttgtccgtctggttgc

SEQ ID NO: 7160 - DNA, 22 bp, unidentified
  misc_feature 1..22: note = Description of Unknown:MG3-6-PD-1-target site-H4 sequence
  source 1..22: mol_type = other DNA
tgtccccttcggtcaccacgag

SEQ ID NO: 7161 - DNA, 22 bp, unidentified
  misc_feature 1..22: note = Description of Unknown:MG3-6-PD-1-target site-A5 sequence
  source 1..22: mol_type = other DNA
agcagggctggggagaaggtgg

SEQ ID NO: 7162 - DNA, 22 bp, unidentified
  misc_feature 1..22: note = Description of Unknown:MG3-6-PD-1-target site-B5 sequence
  source 1..22: mol_type = other DNA
tggggagaaggtgggggggttc

SEQ ID NO: 7163 - DNA, 22 bp, unidentified
  misc_feature 1..22: note = Description of Unknown:MG3-6-PD-1-target site-C5 sequence
  source 1..22: mol_type = other DNA
ctccatctctcagactccccag

SEQ ID NO: 7164 - DNA, 22 bp, unidentified
  misc_feature 1..22: note = Description of Unknown:MG3-6-PD-1-target site-D5 sequence
  source 1..22: mol_type = other DNA
gccaggatggttcttaggtagg

SEQ ID NO: 7165 - DNA, 22 bp, unidentified
  misc_feature 1..22: note = Description of Unknown:MG3-6-PD-1-target site-E5 sequence
  source 1..22: mol_type = other DNA
agtcgtctgggcggtgctacaa

SEQ ID NO: 7166 - DNA, 22 bp, unidentified
  misc_feature 1..22: note = Description of Unknown:MG3-6-PD-1-target site-F5 sequence
  source 1..22: mol_type = other DNA
agacgactggccagggcgcctg

SEQ ID NO: 7167 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
atctgtctggtttcgcgagacagttgagaatcgaaagattcttaataaggcatccttccgatgctgacttctcaccgtccgttttccaataggagcgggcggtatgtttt

SEQ ID NO: 7168 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
tttcgcgagacaccaggctaccgttgagaatcgaaagattcttaataaggcatccttccgatgctgacttctcaccgtccgttttccaataggagcgggcggtatgtttt

SEQ ID NO: 7169 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
agcaagtacaacaaatggaaaagttgagaatcgaaagattcttaataaggcatccttccgatgctgacttctcaccgtccgttttccaataggagcgggcggtatgtttt

SEQ ID NO: 7170 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 107^108: mod_base = OTHER; note = phosphorothioate bond
  modified_base 108^109: mod_base = OTHER; note = phosphorothioate bond
  modified_base 109^110: mod_base = OTHER; note = phosphorothioate bond
gcaaaagctaaaatttttctatgttgagaatcgaaagattcttaataaggcatccttccgatgctgacttctcaccgtccgttttccaataggagcgggcggtatgtttt

SEQ ID NO: 7171 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = gm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tgctacactttggtggtgcagcgttgagaatcgaaagattcttaataaggcatccttccgatgctgacttctcaccgtccgttttccaataggagcgggcggtatgtttt

SEQ ID NO: 7172 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
actcccctgcagggcaacgcccgttgagaatcgaaagattcttaataaggcatccttccgatgctgacttctcaccgtccgttttccaataggagcgggcggtatgtttt

SEQ ID NO: 7173 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cgactcgacatggaggcgatgagttgagaatcgaaagattcttaataaggcatccttccgatgctgacttctcaccgtccgttttccaataggagcgggcggtatgtttt

SEQ ID NO: 7174 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
atcacgcgaggaggaaaggagggttgagaatcgaaagattcttaataaggcatccttccgatgctgacttctcaccgtccgttttccaataggagcgggcggtatgtttt

SEQ ID NO: 7175 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
aggaaaggagggagggcttcttgttgagaatcgaaagattcttaataaggcatccttccgatgctgacttctcaccgtccgttttccaataggagcgggcggtatgtttt

SEQ ID NO: 7176 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
acctcctccaccgcagctccctgttgagaatcgaaagattcttaataaggcatccttccgatgctgacttctcaccgtccgttttccaataggagcgggcggtatgtttt

SEQ ID NO: 7177 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gcgcctcccacccacaaaccaggttgagaatcgaaagattcttaataaggcatccttccgatgctgacttctcaccgtccgttttccaataggagcgggcggtatgtttt

SEQ ID NO: 7178 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cccacccccacgagtgcctgtagttgagaatcgaaagattcttaataaggcatccttccgatgctgacttctcaccgtccgttttccaataggagcgggcggtatgtttt

SEQ ID NO: 7179 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ctcgtgggggtgggggaggagcgttgagaatcgaaagattcttaataaggcatccttccgatgctgacttctcaccgtccgttttccaataggagcgggcggtatgtttt

SEQ ID NO: 7180 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gctgcggtggaggaggtggagagttgagaatcgaaagattcttaataaggcatccttccgatgctgacttctcaccgtccgttttccaataggagcgggcggtatgtttt

SEQ ID NO: 7181 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tctctgctgcctcccgtcttgtgttgagaatcgaaagattcttaataaggcatccttccgatgctgacttctcaccgtccgttttccaataggagcgggcggtatgtttt

SEQ ID NO: 7182 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ctcccgtcttgtaaggaccgccgttgagaatcgaaagattcttaataaggcatccttccgatgctgacttctcaccgtccgttttccaataggagcgggcggtatgtttt

SEQ ID NO: 7183 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = gm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cgagtcgcttctcgattatggggttgagaatcgaaagattcttaataaggcatccttccgatgctgacttctcaccgtccgttttccaataggagcgggcggtatgtttt

SEQ ID NO: 7184 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
attatgggcgggattcttttgcgttgagaatcgaaagattcttaataaggcatccttccgatgctgacttctcaccgtccgttttccaataggagcgggcggtatgtttt

SEQ ID NO: 7185 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = gm
  modified_base 3: mod_base = gm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gggattcttttgcctaggcttagttgagaatcgaaagattcttaataaggcatccttccgatgctgacttctcaccgtccgttttccaataggagcgggcggtatgtttt

SEQ ID NO: 7186 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cctgcaggggagtgagcagctggttgagaatcgaaagattcttaataaggcatccttccgatgctgacttctcaccgtccgttttccaataggagcgggcggtatgtttt

SEQ ID NO: 7187 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
actccgattagtttatcttcccgttgagaatcgaaagattcttaataaggcatccttccgatgctgacttctcaccgtccgttttccaataggagcgggcggtatgtttt

SEQ ID NO: 7188 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
tcccacggactagagttggtgtgttgagaatcgaaagattcttaataaggcatccttccgatgctgacttctcaccgtccgttttccaataggagcgggcggtatgtttt

SEQ ID NO: 7189 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = OTHER; note = 2-O-methyladenosine
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
aaatggagcttagtcattcaccgttgagaatcgaaagattcttaataaggcatccttccgatgctgacttctcaccgtccgttttccaataggagcgggcggtatgtttt

SEQ ID NO: 7190 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
acctggggctgattttatgcaagttgagaatcgaaagattcttaataaggcatccttccgatgctgacttctcaccgtccgttttccaataggagcgggcggtatgtttt

SEQ ID NO: 7191 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gctgattttatgcaacgagactgttgagaatcgaaagattcttaataaggcatccttccgatgctgacttctcaccgtccgttttccaataggagcgggcggtatgtttt

SEQ ID NO: 7192 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
atcacctgagttttataccattgttgagaatcgaaagattcttaataaggcatccttccgatgctgacttctcaccgtccgttttccaataggagcgggcggtatgtttt

SEQ ID NO: 7193 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gctgcaccaccaaagtgtagcagttgagaatcgaaagattcttaataaggcatccttccgatgctgacttctcaccgtccgttttccaataggagcgggcggtatgtttt

SEQ ID NO: 7194 - RNA, 110 nt, synthetic construct
  misc_feature 1..110: note = Description of Artificial Sequence: Syntheticpolynucleotide
  source 1..110: mol_type = other RNA
  modified_base 1: mod_base = um
  modified_base 2: mod_base = um
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
ttccctccctcaccctctctccgttgagaatcgaaagattcttaataaggcatccttccgatgctgacttctcaccgtccgttttccaataggagcgggcggtatgtttt

SEQ ID NO: 7195 - RNA, 110 nt, synthetic construct
  misc_feature 1..110: note = Description of Artificial Sequence: Syntheticpolynucleotide
  source 1..110: mol_type = other RNA
  modified_base 1: mod_base = gm
  modified_base 2: mod_base = cm
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
gcctggtgtctcgcgaaaccaggttgagaatcgaaagattcttaataaggcatccttccgatgctgacttctcaccgtccgttttccaataggagcgggcggtatgtttt

SEQ ID NO: 7196 - RNA, 110 nt, synthetic construct
  misc_feature 1..110: note = Description of Artificial Sequence: Syntheticpolynucleotide
  source 1..110: mol_type = other RNA
  modified_base 1: mod_base = OTHER; note = 2-O-methyladenosine
  modified_base 2: mod_base = cm
  modified_base 3: mod_base = OTHER; note = 2-O-methyladenosine
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
acagattggttccaccacaaatgttgagaatcgaaagattcttaataaggcatccttccgatgctgacttctcaccgtccgttttccaataggagcgggcggtatgtttt

SEQ ID NO: 7197 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = cm
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
caccacaaattaaggcttgagcgttgagaatcgaaagattcttaataaggcatccttccgatgctgacttctcaccgtccgttttccaataggagcgggcggtatgtttt

SEQ ID NO: 7198 - RNA, 110 nt, synthetic construct
  misc_feature 1..110: note = Description of Artificial Sequence: Syntheticpolynucleotide
  source 1..110: mol_type = other RNA
  modified_base 1: mod_base = cm
  modified_base 2: mod_base = OTHER; note = 2-O-methyladenosine
  modified_base 3: mod_base = um
  modified_base 108: mod_base = um
  modified_base 109: mod_base = um
  modified_base 110: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 107^108: mod_base = OTHER; note = Phosphorothioate bond
  modified_base 108^109: mod_base = OTHER; note = Phosphorothioate bond
  modified_base 109^110: mod_base = OTHER; note = Phosphorothioate bond
cattttatcctttttccttagcgttgagaatcgaaagattcttaataaggcatccttccgatgctgacttctcaccgtccgttttccaataggagcgggcggtatgtttt

SEQ ID NO: 7199 - DNA, 22 bp, unidentified
  misc_feature 1..22: note = Description of Unknown:MG3-6-hRosa26-target site- A1 sequence
  source 1..22: mol_type = other DNA
atctgtctggtttcgcgagaca

SEQ ID NO: 7200 - DNA, 22 bp, unidentified
  misc_feature 1..22: note = Description of Unknown:MG3-6-hRosa26-target site- B1 sequence
  source 1..22: mol_type = other DNA
tttcgcgagacaccaggctacc

SEQ ID NO: 7201 - DNA, 22 bp, unidentified
  misc_feature 1..22: note = Description of Unknown:MG3-6-hRosa26-target site- C1 sequence
  source 1..22: mol_type = other DNA
agcaagtacaacaaatggaaaa

SEQ ID NO: 7202 - DNA, 22 bp, unidentified
  misc_feature 1..22: note = Description of Unknown:MG3-6-hRosa26-target site- D1 sequence
  source 1..22: mol_type = other DNA
gcaaaagctaaaatttttctat

SEQ ID NO: 7203 - DNA, 22 bp, unidentified
  misc_feature 1..22: note = Description of Unknown:MG3-6-hRosa26-target site- E1 sequence
  source 1..22: mol_type = other DNA
tgctacactttggtggtgcagc

SEQ ID NO: 7204 - DNA, 22 bp, unidentified
  misc_feature 1..22: note = Description of Unknown:MG3-6-hRosa26-target site- F1 sequence
  source 1..22: mol_type = other DNA
actcccctgcagggcaacgccc

SEQ ID NO: 7205 - DNA, 22 bp, unidentified
  misc_feature 1..22: note = Description of Unknown:MG3-6-hRosa26-target site- G1 sequence
  source 1..22: mol_type = other DNA
cgactcgacatggaggcgatga

SEQ ID NO: 7206 - DNA, 22 bp, unidentified
  misc_feature 1..22: note = Description of Unknown:MG3-6-hRosa26-target site- H1 sequence
  source 1..22: mol_type = other DNA
atcacgcgaggaggaaaggagg

SEQ ID NO: 7207 - DNA, 22 bp, unidentified
  misc_feature 1..22: note = Description of Unknown:MG3-6-hRosa26-target site- A2 sequence
  source 1..22: mol_type = other DNA
aggaaaggagggagggcttctt

SEQ ID NO: 7208 - DNA, 22 bp, unidentified
  misc_feature 1..22: note = Description of Unknown:MG3-6-hRosa26-target site- B2 sequence
  source 1..22: mol_type = other DNA
acctcctccaccgcagctccct

SEQ ID NO: 7209 - DNA, 22 bp, unidentified
  misc_feature 1..22: note = Description of Unknown:MG3-6-hRosa26-target site- C2 sequence
  source 1..22: mol_type = other DNA
gcgcctcccacccacaaaccag

SEQ ID NO: 7210 - DNA, 22 bp, unidentified
  misc_feature 1..22: note = Description of Unknown:MG3-6-hRosa26-target site- D2 sequence
  source 1..22: mol_type = other DNA
cccacccccacgagtgcctgta

SEQ ID NO: 7211 - DNA, 22 bp, unidentified
  misc_feature 1..22: note = Description of Unknown:MG3-6-hRosa26-target site- E2 sequence
  source 1..22: mol_type = other DNA
ctcgtgggggtgggggaggagc

SEQ ID NO: 7212 - DNA, 22 bp, unidentified
  misc_feature 1..22: note = Description of Unknown:MG3-6-hRosa26-target site- F2 sequence
  source 1..22: mol_type = other DNA
gctgcggtggaggaggtggaga

SEQ ID NO: 7213 - DNA, 22 bp, unidentified
  misc_feature 1..22: note = Description of Unknown:MG3-6-hRosa26-target site- G2 sequence
  source 1..22: mol_type = other DNA
tctctgctgcctcccgtcttgt

SEQ ID NO: 7214 - DNA, 22 bp, unidentified
  misc_feature 1..22: note = Description of Unknown:MG3-6-hRosa26-target site- H2 sequence
  source 1..22: mol_type = other DNA
ctcccgtcttgtaaggaccgcc

SEQ ID NO: 7215 - DNA, 22 bp, unidentified
  misc_feature 1..22: note = Description of Unknown:MG3-6-hRosa26-target site- A3 sequence
  source 1..22: mol_type = other DNA
cgagtcgcttctcgattatggg

SEQ ID NO: 7216 - DNA, 22 bp, unidentified
  misc_feature 1..22: note = Description of Unknown:MG3-6-hRosa26-target site- B3 sequence
  source 1..22: mol_type = other DNA
attatgggcgggattcttttgc

SEQ ID NO: 7217 - DNA, 22 bp, unidentified
  misc_feature 1..22: note = Description of Unknown:MG3-6-hRosa26-target site- C3 sequence
  source 1..22: mol_type = other DNA
gggattcttttgcctaggctta

SEQ ID NO: 7218 - DNA, 22 bp, unidentified
  misc_feature 1..22: note = Description of Unknown:MG3-6-hRosa26-target site- D3 sequence
  source 1..22: mol_type = other DNA
cctgcaggggagtgagcagctg

SEQ ID NO: 7219 - DNA, 22 bp, unidentified
  misc_feature 1..22: note = Description of Unknown:MG3-6-hRosa26-target site- E3 sequence
  source 1..22: mol_type = other DNA
actccgattagtttatcttccc

SEQ ID NO: 7220 - DNA, 22 bp, unidentified
  misc_feature 1..22: note = Description of Unknown:MG3-6-hRosa26-target site- F3 sequence
  source 1..22: mol_type = other DNA
tcccacggactagagttggtgt

SEQ ID NO: 7221 - DNA, 22 bp, unidentified
  misc_feature 1..22: note = Description of Unknown:MG3-6-hRosa26-target site- G3 sequence
  source 1..22: mol_type = other DNA
aaatggagcttagtcattcacc

SEQ ID NO: 7222 - DNA, 22 bp, unidentified
  misc_feature 1..22: note = Description of Unknown:MG3-6-hRosa26-target site- H3 sequence
  source 1..22: mol_type = other DNA
acctggggctgattttatgcaa

SEQ ID NO: 7223 - DNA, 22 bp, unidentified
  misc_feature 1..22: note = Description of Unknown:MG3-6-hRosa26-target site- A4 sequence
  source 1..22: mol_type = other DNA
gctgattttatgcaacgagact

SEQ ID NO: 7224 - DNA, 22 bp, unidentified
  misc_feature 1..22: note = Description of Unknown:MG3-6-hRosa26-target site- B4 sequence
  source 1..22: mol_type = other DNA
atcacctgagttttataccatt

SEQ ID NO: 7225 - DNA, 22 bp, unidentified
  misc_feature 1..22: note = Description of Unknown:MG3-6-hRosa26-target site- C4 sequence
  source 1..22: mol_type = other DNA
gctgcaccaccaaagtgtagca

SEQ ID NO: 7226 - DNA, 22 bp, unidentified
  misc_feature 1..22: note = Description of Unknown:MG3-6-hRosa26-target site- D4 sequence
  source 1..22: mol_type = other DNA
ttccctccctcaccctctctcc

SEQ ID NO: 7227 - DNA, 22 bp, unidentified
  misc_feature 1..22: note = Description of Unknown:MG3-6-hRosa26-target site- E4 sequence
  source 1..22: mol_type = other DNA
gcctggtgtctcgcgaaaccag

SEQ ID NO: 7228 - DNA, 22 bp, unidentified
  misc_feature 1..22: note = Description of Unknown:MG3-6-hRosa26-target site- F4 sequence
  source 1..22: mol_type = other DNA
acagattggttccaccacaaat

SEQ ID NO: 7229 - DNA, 22 bp, unidentified
  misc_feature 1..22: note = Description of Unknown:MG3-6-hRosa26-target site- G4 sequence
  source 1..22: mol_type = other DNA
caccacaaattaaggcttgagc

SEQ ID NO: 7230 - DNA, 22 bp, unidentified
  misc_feature 1..22: note = Description of Unknown:MG3-6-hRosa26-target site- H4 sequence
  source 1..22: mol_type = other DNA
cattttatcctttttccttagc

SEQ ID NO: 7231 - RNA, 117 nt, synthetic construct
  misc_feature 1..117: note = Description of Artificial Sequence: Syntheticpolynucleotide
  source 1..117: mol_type = other RNA
  modified_base 1: mod_base = cm
  modified_base 2: mod_base = OTHER; note = 2-O-methyladenosine
  modified_base 3: mod_base = cm
  modified_base 115: mod_base = um
  modified_base 116: mod_base = um
  modified_base 117: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
  modified_base 116^117: mod_base = OTHER; note = Phosphorothioate bond
caccttcttccccagcccaggtgttgtagttccccttttgaaaaaaagtgtgttactgcaataaggtaaaacaccacgaagctctgccctaactgccttagcagttagggcatcttt

SEQ ID NO: 7232 - RNA, 117 nt, synthetic construct
  misc_feature 1..117: note = Description of Artificial Sequence: Syntheticpolynucleotide
  source 1..117: mol_type = other RNA
  modified_base 1: mod_base = cm
  modified_base 2: mod_base = OTHER; note = 2-O-methyladenosine
  modified_base 3: mod_base = OTHER; note = 2-O-methyladenosine
  modified_base 115: mod_base = um
  modified_base 116: mod_base = um
  modified_base 117: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
  modified_base 116^117: mod_base = OTHER; note = Phosphorothioate bond
caagagcaacagtgctgtggccgttgtagttccccttttgaaaaaaagtgtgttactgcaataaggtaaaacaccacgaagctctgccctaactgccttagcagttagggcatcttt

SEQ ID NO: 7233 - RNA, 117 nt, synthetic construct
  misc_feature 1..117: note = Description of Artificial Sequence: Syntheticpolynucleotide
  source 1..117: mol_type = other RNA
  modified_base 1: mod_base = OTHER; note = 2-O-methyladenosine
  modified_base 2: mod_base = gm
  modified_base 3: mod_base = OTHER; note = 2-O-methyladenosine
  modified_base 115: mod_base = um
  modified_base 116: mod_base = um
  modified_base 117: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
  modified_base 116^117: mod_base = OTHER; note = Phosphorothioate bond
agacatgaggtctatggacttcgttgtagttccccttttgaaaaaaagtgtgttactgcaataaggtaaaacaccacgaagctctgccctaactgccttagcagttagggcatcttt

SEQ ID NO: 7234 - RNA, 117 nt, synthetic construct
  misc_feature 1..117: note = Description of Artificial Sequence: Syntheticpolynucleotide
  source 1..117: mol_type = other RNA
  modified_base 1: mod_base = cm
  modified_base 2: mod_base = cm
  modified_base 3: mod_base = OTHER; note = 2-O-methyladenosine
  modified_base 115: mod_base = um
  modified_base 116: mod_base = um
  modified_base 117: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 114^115: mod_base = OTHER; note = Phosphorothioate bond
  modified_base 115^116: mod_base = OTHER; note = Phosphorothioate bond
  modified_base 116^117: mod_base = OTHER; note = Phosphorothioate bond
ccaaagctgcccttacctgggcgttgtagttccccttttgaaaaaaagtgtgttactgcaataaggtaaaacaccacgaagctctgccctaactgccttagcagttagggcatcttt

SEQ ID NO: 7235 - DNA, 22 bp, unidentified
  misc_feature 1..22: note = Description of Unknown:MG21-1-TRAC-target site-H9 sequence
  source 1..22: mol_type = other DNA
caccttcttccccagcccaggt

SEQ ID NO: 7236 - DNA, 22 bp, unidentified
  misc_feature 1..22: note = Description of Unknown:MG21-1-TRAC-target site-B7 sequence
  source 1..22: mol_type = other DNA
caagagcaacagtgctgtggcc

SEQ ID NO: 7237 - DNA, 22 bp, unidentified
  misc_feature 1..22: note = Description of Unknown:MG21-1-TRAC-target site-D6 sequence
  source 1..22: mol_type = other DNA
agacatgaggtctatggacttc

SEQ ID NO: 7238 - DNA, 22 bp, unidentified
  misc_feature 1..22: note = Description of Unknown:MG21-1-TRAC-target site-C10 sequence
  source 1..22: mol_type = other DNA
ccaaagctgcccttacctgggc

SEQ ID NO: 7239 - RNA, 113 nt, synthetic construct
  misc_feature 1..113: note = Description of Artificial Sequence: Syntheticpolynucleotide
  source 1..113: mol_type = other RNA
  modified_base 1: mod_base = cm
  modified_base 2: mod_base = cm
  modified_base 3: mod_base = gm
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
ccgtgtaccagctgagagactcgtttgagaacctgaaaaggtgagtgcaaataaggtttaaccgaaattgtttacctgcattgtgcagtataagaaagaccgcgaggtctttt

SEQ ID NO: 7240 - RNA, 113 nt, synthetic construct
  misc_feature 1..113: note = Description of Artificial Sequence: Syntheticpolynucleotide
  source 1..113: mol_type = other RNA
  modified_base 1: mod_base = um
  modified_base 2: mod_base = um
  modified_base 3: mod_base = gm
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
ttgggttccgaatcctcctcctgtttgagaacctgaaaaggtgagtgcaaataaggtttaaccgaaattgtttacctgcattgtgcagtataagaaagaccgcgaggtctttt

SEQ ID NO: 7241 - RNA, 113 nt, synthetic construct
  misc_feature 1..113: note = Description of Artificial Sequence: Syntheticpolynucleotide
  source 1..113: mol_type = other RNA
  modified_base 1: mod_base = OTHER; note = 2-O-methyladenosine
  modified_base 2: mod_base = cm
  modified_base 3: mod_base = OTHER; note = 2-O-methyladenosine
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
acagtgctgtggcctggagcaagtttgagaacctgaaaaggtgagtgcaaataaggtttaaccgaaattgtttacctgcattgtgcagtataagaaagaccgcgaggtctttt

SEQ ID NO: 7242 - RNA, 113 nt, synthetic construct
  misc_feature 1..113: note = Description of Artificial Sequence: Syntheticpolynucleotide
  source 1..113: mol_type = other RNA
  modified_base 1: mod_base = um
  modified_base 2: mod_base = gm
  modified_base 3: mod_base = OTHER; note = 2-O-methyladenosine
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
tgaaagtttaggttcgtatctggtttgagaacctgaaaaggtgagtgcaaataaggtttaaccgaaattgtttacctgcattgtgcagtataagaaagaccgcgaggtctttt

SEQ ID NO: 7243 - RNA, 113 nt, synthetic construct
  misc_feature 1..113: note = Description of Artificial Sequence: Syntheticpolynucleotide
  source 1..113: mol_type = other RNA
  modified_base 1: mod_base = gm
  modified_base 2: mod_base = cm
  modified_base 3: mod_base = um
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
gcttgacatcacaggaactttcgtttgagaacctgaaaaggtgagtgcaaataaggtttaaccgaaattgtttacctgcattgtgcagtataagaaagaccgcgaggtctttt

SEQ ID NO: 7244 - RNA, 113 nt, synthetic construct
  misc_feature 1..113: note = Description of Artificial Sequence: Syntheticpolynucleotide
  source 1..113: mol_type = other RNA
  modified_base 1: mod_base = OTHER; note = 2-O-methyladenosine
  modified_base 2: mod_base = OTHER; note = 2-O-methyladenosine
  modified_base 3: mod_base = cm
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
aacccaatcactgacaggttttgtttgagaacctgaaaaggtgagtgcaaataaggtttaaccgaaattgtttacctgcattgtgcagtataagaaagaccgcgaggtctttt

SEQ ID NO: 7245 - RNA, 113 nt, synthetic construct
  misc_feature 1..113: note = Description of Artificial Sequence: Syntheticpolynucleotide
  source 1..113: mol_type = other RNA
  modified_base 1: mod_base = cm
  modified_base 2: mod_base = cm
  modified_base 3: mod_base = um
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
cctgtgatgtcaagctggtcgagtttgagaacctgaaaaggtgagtgcaaataaggtttaaccgaaattgtttacctgcattgtgcagtataagaaagaccgcgaggtctttt

SEQ ID NO: 7246 - RNA, 113 nt, synthetic construct
  misc_feature 1..113: note = Description of Artificial Sequence: Syntheticpolynucleotide
  source 1..113: mol_type = other RNA
  modified_base 1: mod_base = um
  modified_base 2: mod_base = OTHER; note = 2-O-methyladenosine
  modified_base 3: mod_base = gm
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
tagacccctgtcttacctgtttgtttgagaacctgaaaaggtgagtgcaaataaggtttaaccgaaattgtttacctgcattgtgcagtataagaaagaccgcgaggtctttt

SEQ ID NO: 7247 - RNA, 113 nt, synthetic construct
  misc_feature 1..113: note = Description of Artificial Sequence: Syntheticpolynucleotide
  source 1..113: mol_type = other RNA
  modified_base 1: mod_base = OTHER; note = 2-O-methyladenosine
  modified_base 2: mod_base = gm
  modified_base 3: mod_base = cm
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
agccgcagcgtcatgagcagatgtttgagaacctgaaaaggtgagtgcaaataaggtttaaccgaaattgtttacctgcattgtgcagtataagaaagaccgcgaggtctttt

SEQ ID NO: 7248 - DNA, 22 bp, unidentified
  misc_feature 1..22: note = Description of Unknown:MG23-1-TRAC-target site-E1 sequence
  source 1..22: mol_type = other DNA
ccgtgtaccagctgagagactc

SEQ ID NO: 7249 - DNA, 22 bp, unidentified
  misc_feature 1..22: note = Description of Unknown:MG23-1-TRAC-target site-H8 sequence
  source 1..22: mol_type = other DNA
ttgggttccgaatcctcctcct

SEQ ID NO: 7250 - DNA, 22 bp, unidentified
  misc_feature 1..22: note = Description of Unknown:MG23-1-TRAC-target site-A3 sequence
  source 1..22: mol_type = other DNA
acagtgctgtggcctggagcaa

SEQ ID NO: 7251 - DNA, 22 bp, unidentified
  misc_feature 1..22: note = Description of Unknown:MG23-1-TRAC-target site-C10 sequence
  source 1..22: mol_type = other DNA
tgaaagtttaggttcgtatctg

SEQ ID NO: 7252 - DNA, 22 bp, unidentified
  misc_feature 1..22: note = Description of Unknown:MG23-1-TRAC-target site-H7 sequence
  source 1..22: mol_type = other DNA
gcttgacatcacaggaactttc

SEQ ID NO: 7253 - DNA, 22 bp, unidentified
  misc_feature 1..22: note = Description of Unknown:MG23-1-TRAC-target site-B10 sequence
  source 1..22: mol_type = other DNA
aacccaatcactgacaggtttt

SEQ ID NO: 7254 - DNA, 22 bp, unidentified
  misc_feature 1..22: note = Description of Unknown:MG23-1-TRAC-target site-H6 sequence
  source 1..22: mol_type = other DNA
cctgtgatgtcaagctggtcga

SEQ ID NO: 7255 - DNA, 22 bp, unidentified
  misc_feature 1..22: note = Description of Unknown:MG23-1-TRAC-target site-E7 sequence
  source 1..22: mol_type = other DNA
tagacccctgtcttacctgttt

SEQ ID NO: 7256 - DNA, 22 bp, unidentified
  misc_feature 1..22: note = Description of Unknown:MG23-1-TRAC-target site-C9 sequence
  source 1..22: mol_type = other DNA
agccgcagcgtcatgagcagat

SEQ ID NO: 7257 - RNA, 113 nt, synthetic construct
  misc_feature 1..113: note = Description of Artificial Sequence: Syntheticpolynucleotide
  source 1..113: mol_type = other RNA
  modified_base 1: mod_base = gm
  modified_base 2: mod_base = cm
  modified_base 3: mod_base = um
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
gctactggccttatctcacagggtttgagaacctgaaaaggtgagtgcaaataaggtttaaccgaaattgtttacctgcattgtgcagtataagaaagaccgcgaggtctttt

SEQ ID NO: 7258 - RNA, 113 nt, synthetic construct
  misc_feature 1..113: note = Description of Artificial Sequence: Syntheticpolynucleotide
  source 1..113: mol_type = other RNA
  modified_base 1: mod_base = cm
  modified_base 2: mod_base = um
  modified_base 3: mod_base = OTHER; note = 2-O-methyladenosine
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
ctactggccttatctcacaggtgtttgagaacctgaaaaggtgagtgcaaataaggtttaaccgaaattgtttacctgcattgtgcagtataagaaagaccgcgaggtctttt

SEQ ID NO: 7259 - RNA, 113 nt, synthetic construct
  misc_feature 1..113: note = Description of Artificial Sequence: Syntheticpolynucleotide
  source 1..113: mol_type = other RNA
  modified_base 1: mod_base = OTHER; note = 2-O-methyladenosine
  modified_base 2: mod_base = cm
  modified_base 3: mod_base = um
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
actgacgcacggaggaacaatagtttgagaacctgaaaaggtgagtgcaaataaggtttaaccgaaattgtttacctgcattgtgcagtataagaaagaccgcgaggtctttt

SEQ ID NO: 7260 - RNA, 113 nt, synthetic construct
  misc_feature 1..113: note = Description of Artificial Sequence: Syntheticpolynucleotide
  source 1..113: mol_type = other RNA
  modified_base 1: mod_base = gm
  modified_base 2: mod_base = gm
  modified_base 3: mod_base = OTHER; note = 2-O-methyladenosine
  modified_base 111: mod_base = um
  modified_base 112: mod_base = um
  modified_base 113: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
  modified_base 112^113: mod_base = OTHER; note = Phosphorothioate bond
ggaacaatataaattggggactgtttgagaacctgaaaaggtgagtgcaaataaggtttaaccgaaattgtttacctgcattgtgcagtataagaaagaccgcgaggtctttt

SEQ ID NO: 7261 - DNA, 22 bp, unidentified
  misc_feature 1..22: note = Description of Unknown:MG23-1-AAVS1-target site-B1 sequence
  source 1..22: mol_type = other DNA
gctactggccttatctcacagg

SEQ ID NO: 7262 - DNA, 22 bp, unidentified
  misc_feature 1..22: note = Description of Unknown:MG23-1-AAVS1-target site-C1 sequence
  source 1..22: mol_type = other DNA
ctactggccttatctcacaggt

SEQ ID NO: 7263 - DNA, 22 bp, unidentified
  misc_feature 1..22: note = Description of Unknown:MG23-1-AAVS1-target site-G1 sequence
  source 1..22: mol_type = other DNA
actgacgcacggaggaacaata

SEQ ID NO: 7264 - DNA, 22 bp, unidentified
  misc_feature 1..22: note = Description of Unknown:MG23-1-AAVS1-target site-B2 sequence
  source 1..22: mol_type = other DNA
ggaacaatataaattggggact

SEQ ID NO: 7265 - RNA, 127 nt, synthetic construct
  misc_feature 1..127: note = Description of Artificial Sequence: Syntheticpolynucleotide
  source 1..127: mol_type = other RNA
  modified_base 1: mod_base = gm
  modified_base 2: mod_base = gm
  modified_base 3: mod_base = OTHER; note = 2-O-methyladenosine
  modified_base 125: mod_base = um
  modified_base 126: mod_base = um
  modified_base 127: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 124^125: mod_base = OTHER; note = Phosphorothioate bond
  modified_base 125^126: mod_base = OTHER; note = Phosphorothioate bond
  modified_base 126^127: mod_base = OTHER; note = Phosphorothioate bond
ggagagggtagcgcagggtggtttgagagtgagaaatcacgagttcaaaaaacatgatttattcaaaccgtcttcttcggaaggccccacagtgtgtggacagtaaagcttgcttcggcaagctttt

SEQ ID NO: 7266 - RNA, 127 nt, synthetic construct
  misc_feature 1..127: note = Description of Artificial Sequence: Syntheticpolynucleotide
  source 1..127: mol_type = other RNA
  modified_base 1: mod_base = gm
  modified_base 2: mod_base = cm
  modified_base 3: mod_base = cm
  modified_base 125: mod_base = um
  modified_base 126: mod_base = um
  modified_base 127: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 124^125: mod_base = OTHER; note = Phosphorothioate bond
  modified_base 125^126: mod_base = OTHER; note = Phosphorothioate bond
  modified_base 126^127: mod_base = OTHER; note = Phosphorothioate bond
gccctgccaggacggggctggtttgagagtgagaaatcacgagttcaaaaaacatgatttattcaaaccgtcttcttcggaaggccccacagtgtgtggacagtaaagcttgcttcggcaagctttt

SEQ ID NO: 7267 - DNA, 20 bp, unidentified
  misc_feature 1..20: note = Description of Unknown:MG71-2-AAVS1-target site-C3 sequence
  source 1..20: mol_type = other DNA
ggagagggtagcgcagggtg

SEQ ID NO: 7268 - DNA, 20 bp, unidentified
  misc_feature 1..20: note = Description of Unknown:MG71-2-AAVS1-target site-E2 sequence
  source 1..20: mol_type = other DNA
gccctgccaggacggggctg

SEQ ID NO: 7269 - RNA, 119 nt, synthetic construct
  misc_feature 1..119: note = Description of Artificial Sequence: Syntheticpolynucleotide
  source 1..119: mol_type = other RNA
  modified_base 1: mod_base = um
  modified_base 2: mod_base = cm
  modified_base 3: mod_base = um
  modified_base 117: mod_base = um
  modified_base 118: mod_base = um
  modified_base 119: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 116^117: mod_base = OTHER; note = Phosphorothioate bond
  modified_base 117^118: mod_base = OTHER; note = Phosphorothioate bond
  modified_base 118^119: mod_base = OTHER; note = Phosphorothioate bond
tcttggttttacagatacgaacctgttatagtgggaaatcactataataagtgaaatcgcaaggctctgttcttgaacatcctttattataaaactcctgccaatcggttgggagtttt

SEQ ID NO: 7270 - DNA, 24 bp, unidentified
  misc_feature 1..24: note = Description of Unknown:MG73-1-TRAC-target site-G3 sequence
  source 1..24: mol_type = other DNA
tcttggttttacagatacgaacct

SEQ ID NO: 7271 - RNA, 112 nt, synthetic construct
  misc_feature 1..112: note = Description of Artificial Sequence: Syntheticpolynucleotide
  source 1..112: mol_type = other RNA
  modified_base 1: mod_base = OTHER; note = 2-O-methyladenosine
  modified_base 2: mod_base = um
  modified_base 3: mod_base = OTHER; note = 2-O-methyladenosine
  modified_base 110: mod_base = um
  modified_base 111: mod_base = um
  modified_base 112: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 109^110: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
atatccagaaccctgaccctgccggttgtagcttccttgaagaaattcaacgttgttacaataaggttttcgaaagattaccgaacccgccctcacttaggtgagggctttt

SEQ ID NO: 7272 - RNA, 112 nt, synthetic construct
  misc_feature 1..112: note = Description of Artificial Sequence: Syntheticpolynucleotide
  source 1..112: mol_type = other RNA
  modified_base 1: mod_base = gm
  modified_base 2: mod_base = gm
  modified_base 3: mod_base = cm
  modified_base 110: mod_base = um
  modified_base 111: mod_base = um
  modified_base 112: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 109^110: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
ggccactttcaggaggaggattcggttgtagcttccttgaagaaattcaacgttgttacaataaggttttcgaaagattaccgaacccgccctcacttaggtgagggctttt

SEQ ID NO: 7273 - RNA, 112 nt, synthetic construct
  misc_feature 1..112: note = Description of Artificial Sequence: Syntheticpolynucleotide
  source 1..112: mol_type = other RNA
  modified_base 1: mod_base = cm
  modified_base 2: mod_base = gm
  modified_base 3: mod_base = cm
  modified_base 110: mod_base = um
  modified_base 111: mod_base = um
  modified_base 112: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 109^110: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
cgcagcgtcatgagcagattaaacgttgtagcttccttgaagaaattcaacgttgttacaataaggttttcgaaagattaccgaacccgccctcacttaggtgagggctttt

SEQ ID NO: 7274 - RNA, 112 nt, synthetic construct
  misc_feature 1..112: note = Description of Artificial Sequence: Syntheticpolynucleotide
  source 1..112: mol_type = other RNA
  modified_base 1: mod_base = cm
  modified_base 2: mod_base = gm
  modified_base 3: mod_base = gm
  modified_base 110: mod_base = um
  modified_base 111: mod_base = um
  modified_base 112: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 109^110: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
cggccactttcaggaggaggattcgttgtagcttccttgaagaaattcaacgttgttacaataaggttttcgaaagattaccgaacccgccctcacttaggtgagggctttt

SEQ ID NO: 7275 - RNA, 112 nt, synthetic construct
  misc_feature 1..112: note = Description of Artificial Sequence: Syntheticpolynucleotide
  source 1..112: mol_type = other RNA
  modified_base 1: mod_base = gm
  modified_base 2: mod_base = cm
  modified_base 3: mod_base = cm
  modified_base 110: mod_base = um
  modified_base 111: mod_base = um
  modified_base 112: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 109^110: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
gccgtgtaccagctgagagactctgttgtagcttccttgaagaaattcaacgttgttacaataaggttttcgaaagattaccgaacccgccctcacttaggtgagggctttt

SEQ ID NO: 7276 - RNA, 112 nt, synthetic construct
  misc_feature 1..112: note = Description of Artificial Sequence: Syntheticpolynucleotide
  source 1..112: mol_type = other RNA
  modified_base 1: mod_base = cm
  modified_base 2: mod_base = cm
  modified_base 3: mod_base = cm
  modified_base 110: mod_base = um
  modified_base 111: mod_base = um
  modified_base 112: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 109^110: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
cccacagatatccagaaccctgacgttgtagcttccttgaagaaattcaacgttgttacaataaggttttcgaaagattaccgaacccgccctcacttaggtgagggctttt

SEQ ID NO: 7277 - RNA, 112 nt, synthetic construct
  misc_feature 1..112: note = Description of Artificial Sequence: Syntheticpolynucleotide
  source 1..112: mol_type = other RNA
  modified_base 1: mod_base = OTHER; note = 2-O-methyladenosine
  modified_base 2: mod_base = um
  modified_base 3: mod_base = cm
  modified_base 110: mod_base = um
  modified_base 111: mod_base = um
  modified_base 112: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 109^110: mod_base = OTHER; note = Phosphorothioate bond
  modified_base 110^111: mod_base = OTHER; note = Phosphorothioate bond
  modified_base 111^112: mod_base = OTHER; note = Phosphorothioate bond
atcctcttgtcccacagatatccagttgtagcttccttgaagaaattcaacgttgttacaataaggttttcgaaagattaccgaacccgccctcacttaggtgagggctttt

SEQ ID NO: 7278 - DNA, 24 bp, unidentified
  misc_feature 1..24: note = Description of Unknown:MG89-2-TRAC-target site-F1 sequence
  source 1..24: mol_type = other DNA
atatccagaaccctgaccctgccg

SEQ ID NO: 7279 - DNA, 24 bp, unidentified
  misc_feature 1..24: note = Description of Unknown:MG89-2-TRAC-target site-G5 sequence
  source 1..24: mol_type = other DNA
ggccactttcaggaggaggattcg

SEQ ID NO: 7280 - DNA, 24 bp, unidentified
  misc_feature 1..24: note = Description of Unknown:MG89-2-TRAC-target site-E5 sequence
  source 1..24: mol_type = other DNA
cgcagcgtcatgagcagattaaac

SEQ ID NO: 7281 - DNA, 24 bp, unidentified
  misc_feature 1..24: note = Description of Unknown:MG89-2-TRAC-target site-F5 sequence
  source 1..24: mol_type = other DNA
cggccactttcaggaggaggattc

SEQ ID NO: 7282 - DNA, 24 bp, unidentified
  misc_feature 1..24: note = Description of Unknown:MG89-2-TRAC-target site-G1 sequence
  source 1..24: mol_type = other DNA
gccgtgtaccagctgagagactct

SEQ ID NO: 7283 - DNA, 24 bp, unidentified
  misc_feature 1..24: note = Description of Unknown:MG89-2-TRAC-target site-E1 sequence
  source 1..24: mol_type = other DNA
cccacagatatccagaaccctgac

SEQ ID NO: 7284 - DNA, 24 bp, unidentified
  misc_feature 1..24: note = Description of Unknown:MG89-2-TRAC-target site-B1 sequence
  source 1..24: mol_type = other DNA
atcctcttgtcccacagatatcca

SEQ ID NO: 7285 - protein, 1056 aa, unidentified
  REGION 1..1056: note = Description of Unknown:uncultivated organism sequence
MENLNDNNVWGFDMGKGSLGEAVRIGNEFKHVESLIIDAEFGEIKTAAGLRRQWRTRKAHKAREAFLEKCLRDCGIEVLQRRKVGLVDGKWQLVQKGDVRLEKEFPAADEDICYNSIALRCKLLLGEKLESWQIFKALNSAIQNRGYDAEIPWKETEVSSKNSEDEYSQKLQIFEKEKDLMLADLETLSEQERNKYDYPCFFKAYKMGLWIPTKPEQVLLRINHNADRAKGYVVPRSYVEKEFVRLVEMASIQYPKLKDKALFILYGVAEKAYASYNSELREQFNLKRGAETDWTALGQKIPKFDNRIVDKCKLIPRFNVCKVKSLSEVKNENDLLYYEITLALKLLNLRFYKNSKIMSLSFAEFKELFEIGRQNKFKISKTNLKKFFKAIHAEILDENQSEIEQPKSTGRASFSRPAMQLLKELIFSGNTPSEFYAKKISTITNTELKKGLVSSDLDFIKLMGNVSWNNIFIPDVETLRYAQEFSENSAKKINQLIGAQNDPIVRHRLSFFYERIKFLEKQFGVPDKIILEFVRDDFIGDKKRKEEQARMKARQKEKLKLAEKLDEIGYKGNKMLLKLELLEKQGGVCLYTDNPLLPTDIPSLEIEHIVPRSRGGPDATYNYVLTREETNKAKGNKTPFEWLGGTSEWASYVDRVNARRKELGSKRCQLLLEEDADKLVEKYTALAETAWIAKLAQRIVCLHFGFQFGGTEGTKRVFTVSGGITSRIRSMYGLNKILHNTEIDKTQSEVDILKLYETLETKNRANKKHHALDAMCLCFAPTGRKTKQLKLDEILPREIAKDAEGYFRRYLDELIPNKVATMKPRLEETIYSKRRFGKKEFIVRKFDLKTLSYKGLNPKYDIGALEKLVKGDDIVNPNVRQIIRDFVNTNPSEQDWINFCDTVRIPSKFGEGSRIKRILVLVGNPAEYKDLSKDNCGAYRKGDSHKGQIIWKATSGKYKVEPIYAHASRTIVEKNLKQNSDFVEIAGFFKSGCLVQIENDVVNDEGLFLLPHGTYMLNTIKYTGQVKLTNCNGISGNAININYLMNAGMKRITINS

SEQ ID NO: 7286 - protein, 1056 aa, unidentified
  REGION 1..1056: note = Description of Unknown:uncultivated organism sequence
MENLDTIWGFDVGKASLGFAVRVGDEIVRASSLIMDEDFGETKTAAALRRQWRTRLAHKAREKYLEERLRECGIEILIRREVGIVDGKWRLVSAGDVRLEKEFPSKGENICYNSIALRCKLILGEKLQGWQIFKALNSAIQNRGYDADIPWKETESGRTSCESENDYAERMSVYEREKSELFEDLTDGENFDYPCFFKANKMGLWSPKNPYFVALRIDNNAESTKNYVVPRSEAEREFLKLVESASVFYPKLKGRGLELLYGEARKPYASFFNSVRMSLGLKRGAESDWTAFGQKVPRFDNRIIDKCRLIPRLNACKIKPLAKITNEADLLPYQTTLLTKLLNLRFFRNGNVEGFTIGELKAAYDIGCKSKFKFTATALRKFLHSIGAEVLDEEQSKIEASREGGRASFSRPAMVLLKELILSGKTPAEFYSEKIRSVSNTDKTKGLVVSDFDFLKLMGACPWNAIFIPDVKMFALANAKETDSEVLINRLIGEQNDPVVRHRLSFFYRRIKELEKEFGVPDRVVLEFVREDFLGSEARKKRNIAMKKRADEKLRTAKKLDEIGFKGNKMLLKMELFQQQGGVCLYTGEPLEQTQIDSLEIEHIVPRSLGGPDSAYNYVLTRERTNKEKADRTPFQWLSADSARWASYCDRVRRNFASLGVKKCRLLMAQNAEELVEKYTALAETAWIAKLAQQIVCLHFGFQFGAMKGRKRVFTVSGGTTARIRGLFGLNRLLHTDIFDESKMTEVEIVKKYAELDKKNRKNQKHHALDAMCLCFVPVNSKASRMTAETLFPKKIRDNAENYFKAILDKIVPEDVARKKPRLEQTIYSARSFGGKLQAVYRVNIADLAYKNENQKKVYNLDSLQKSVNSDKIINPVIKSLVSDFSETNPTEEEWLNWCNTVRIPAKRGAGSRIKRVLVRKGNIDEYKDLSKDGCGAYKCGDANKSQIVWRDTKGKCRVCPVYVHASRFDVLEALKRRPDFSEIVGEFKSHCLVSIASDVFGKSGEKIMPAGTYMLNTIIYTGATVLTNPDGVKSKAVNINYLIDAGMKRKEGSRK

SEQ ID NO: 7287 - protein, 1350 aa, unidentified
  REGION 1..1350: note = Description of Unknown:uncultivated organism sequence
MKLNCEETVWAFDLGKGSIGEAVRQGTRFLHKESLLIPAELARRGPATVSGTPASRYRAMKTRQAHRKREEWLEKVWKAAGLTPLQARKPEYVGYQLRRKKKRVRGKSKWKNVKVGGRWILPPSGKADYRLEREFAPKQIEREGGQLVEVKYPEGKAADGAPAATAEDFGTCYTSCLLRIKLLEWKEGERKLAEWQIYKALRAALQRRGYGRVPWATKEARKQGKSAEELEAEEEKKLQQADPRYREAVDKWKQFKSEVPAEFQLPCYYDALHMGLWRYVPEQQQGHLGYWNPENEPAKPPHGSYRTDHKAESTRNIRSDRTAVRAELTRLGDQAAAMLPKLRDAFARWQREGWKFAHPFQEGKQLTYPIHAKSFGEFLCDGPAGQPVERSFEAFLKQRREAGVRRGSFEEWMAGLGQKTPSFDNRILNGCVLIPRYHVCKVDVRLETDGDGKPTGRLVPESLLASEVTLLLKLKNLLVADAKAGQRKLTVQEVRSVFDFAQRRLRSLALLTPEGELVKEWPQKVADRFAINKSHRQAIAAESELLARVRALTVTSKGAAQPLSTEDAELLLRAVATSKKGASVELPEPMKPLLKAAKAEWKKAKDAADQTLLRPMPGHEEVKAPKSSGRSAYSRVALRILKELILSGEAPSVFHDRLMRRDTELLQRLGPSPGKLLVIFNDSTAADEDQRKQEDTENRKRGLLVSELGFLRQMRKDNTAEDSWENIFIPSQTLEALQQRHTEDGKLDADAAIGELLGTIKDPIVRHRLEVFNQRLKKLQFGDEEEAIPAFGVPDAVVLEFVREDFMGEEAKRELKDFQSKREAARKTAREEAQKSGSTEKSAPLKYELCNTQGGICLYCGQPFSRARLDEYAIDHIVPLGEQGPDAMVNKVLAHRECNEAKGKQTPFQWWHHNTTGKAPTISWDGYTALVEKYRTTLRNKKVQLLTREDAPELVERYTALAETAWVSKLAQTIANLRFGWKNGTDYSGPKPVKRVIVVSGGLTARVRRKYGLDKLLYTEVTDAEVLAKKVKNRDDKRHHALDAMVLTFIPQWARDPNKEGFFRFPAAFRNAEGREDYQTIRKLFQQHLAEVMPRNIAYERAALADTSFGCRLDGGKPVIVQRVAVLDLRQKPAGAPGKTTFDLIYLVKQIQSVRDATIRRRLEEFAATNPDEPKWKAFCESFAQKREDGTTGARILKVCVNAAAPDEFKDLSKDGEGAWRKAKGDHQGQIIYTDADGNLAVKPVYVHASIRQELTRIVQTGGKSKVHCFVRSKCLFRLRKELPQPDYRLVIKNEQKQKRRVQATAPLAPGTFMLNTIITASMDVEFSSAGNQRVVAPLQALLVAGFETI

SEQ ID NO: 7288 - protein, 1350 aa, unidentified
  REGION 1..1350: note = Description of Unknown:uncultivated organism sequence
MKLNCEETVWAFDLGKGSIGEAVRQGTRFLHKESLLIPAELARRGPATVSGTPASRYRAMKTRQAHRKREEWLEKVWKAAGLTPLQARKPEYVGYQLRRKKKRVRGKSKWKNVKVGGRWILPPSGKADYRLEREFAPKQIEREGGQLVEVKYPEGKAADGAPAATAEDFGTCYTSCLLRIKLLEWKEGERKLAEWQIYKALRAALQRRGYGRVPWATKEARKQGKSAEELEAEEEKKLQQADPRYREAVDKWKQFQSAVPAEFQLPCYYDALHMGLWRYVPEQQQGHLGYWNPENEPAKPPHGSYRTDHKAESTRNIRSDRTAVRAELTRLGDQAAAMLPKLRDAFARWQREGWKFAHPFQEGKQLTYPIHAKSFGEFLCDGPAGQPVERSFEAFLKQRREAGVRRGSFEEWMAGLGQKTPSFDNRILNGCVLIPRYHVCKVDVRLETDGDGKPTGRLVPESLLASEVTLLLKLKNLLVADAKAGQRKLTVQEVRSVFDFAQRRLRSLALLTPEGELVKEWPQKVADRFAINKSHWQAIAAESELLARVRALTVTSKGAAQPLSTEDAELLLRAVATSKKGASVELPEPMKPLLKAAKAEWKKAKDAADQTLLRPMPGHEEVKAPKSSGRSAYSRVALRILKELILSGEAPSVFHDRLMRRDTELLQRLGPSPGKLLVIFNDSTAADEDQRKQEDTENRKRGLLVSELGFLRQMRKDNTAEDSWENIFIPSQTLEALQQRHTEDGKLDADAAIGELLGTIKDPIVRHRLEVFNQRLKKLQFGDEEEAIPAFGVPDAVVLEFVREDFMGEEAKRELKDFQSKREAARKTAREEAQKSGSTEKSAPLKYELCNTQGGICLYCGQPFSRARLDEYAIDHIVPLGEQGPDAMVNKVLAHRECNEAKGKQTPFQWWHHNTTGKAPTISWDGYTALVEKYRTTLRNKKVQLLTREDAPELVERYTALAETAWVSKLAQTIANLRFGWKNGTDYSGPKPVKRVIVVSGGLTARVRRKYGLDKLLYTEVTDAEVLAKKVKNRDDKRHHALDAMVLTFIPQWARDPNKEGFFRFPAAFRNAEGREDYQTIRKLFQQHLAEVMPRNIAYERAALADTSFGCRLDGGKPVIVQRVAVLDLGQKPAGAPGKTTFDLIYLVKQIQSVRDATIRRRLEEFAATNPDEPKWKAFCESFAQKREDGTTGARILKVCVNAAAPDEFKDLSKDGEGAWRKAKGDHQGQIIYTDADGNLAVKPVYVHASIRQELTRIVQTGGKSKVHCFVRSKCLFRLRKELPQPDYRLVIKNEQKQKRRVQATAPLAPGTFMLNTIITASMDVEFSSAGNQRVVAPLQALLVAGFETI

SEQ ID NO: 7289 - protein, 1317 aa, unidentified
  REGION 1..1317: note = Description of Unknown:uncultivated organism sequence
MKTYFLKEKPEPPSNDTVWAFDLGKGSIGEAVRRGNEFKHGESLLIPPELARRGPAKDSGTPANRYRALKTREAHHERERWLETVWTAIKLPVLRPREVWQNPETKKWELKHPADYQLEREFAPAEFSRDAKTGGQEKIVYPNGRAENDCAPAATPEDFDICYTSSLLRIKLLNGDSTLKDWQIYKALRAAIQCRGYGTVPWATKEARKQGKSAKELEQEEEKKLQQADPRYRDAVGRWPDFKRDLQKQNLPLFAGMQPSAAAKKYLRLPEDYYFVPPCYYDAWKMGLWNPAEPGKLLARSNHRANSTRNVRFDRIDVRAELIKLGDQAAALLPQIREAFAGWQRDGWNIRHPVTGAEKNYSVHAKTFGEFLCDGPAGQPDESSFEAFLQQREKAGLHRGSYEEWMAALGQKTPSFDNRILNNCTLIPRYHVCKVDVRLEAGKNGNITGRLVPESLLATEVTLLLKLKNLLVADPSAGQRKLTVEELTDIFAYAHRRLKALNLVTPDGELIKEWPTKVAARFGLNESDWNKIAAESEFLRKIKLFTVGSGGASRALTDEEEAGWLLRAVADSKGKTALELPENLKALFKAAKAEWKKAKTAVEQNHLRPMPGHEDVKAPRPSGRSGYSRVALRIIKELIISGQAPSVFHARLVQREAKLLGDLGSSPGKPLCLFNDSVVADKKQREREDTENRKRGLLVSELNFLLQMRRDNAAEDSWKNIFIPSQTIDALQQRHTHDDKLDADAAIRELLGTINDPIVRHRLEVFDKRLKKLQFGDAKENIPSFGVPDAIVLEFVREDFMGEKAKRELKDFQNKREAARKTAREETAKAGVTERSAPLRYELCMAQGGVCLYCGQTFSLAKFEDYAVDHIVPVGVQGPDAMVNKVLAHQECNEAKGRQTPFQWWHHNTSSKAPTISWDGYKALVEKNATTLRNKKVQLLTREDAPDLVERYTALAETAWVSKLAQTIANLRFGWTNGYDQNRKKRVIVVSGGLTARVRRKYGLDKLLYKKDTDIEAFAKKLKNRADKRHHALDAMVLTFIPQWARDPGKEGFFKFPAELGDYDQIRKLFDDSIAKVTPRYLAFEQPGLADTAYGQRDNGTMMVQRSLLRDLAYKSEQQKPVFNLTYAATQIKDVRDERIKKELLKFIATSPDKFAWDAFCNKFEKGELDSMRGIKVSKVLQNRKEAPSEFKDMSKDGTGAFRTRKEGHRGQFVYLDAKGKPRVEVVRVFDSIAKVKAEIEARGKGIRVIGFYQSLCLVKLDKPVVHGTVTLEPGTYQLNTIKKDGQGRAQVTSAGGEKSLEISLGKFLAAGFTRAD

SEQ ID NO: 7290 - protein, 1319 aa, unidentified
  REGION 1..1319: note = Description of Unknown:uncultivated organism sequence
MDAKEHALKTDGNSPSKKNEIVWAFDLGKGSIGEAVRQGKDFLHKASLLIPAELGRRGPATVSGTPANRYRAMKTREAHHERERWLEKVWTAVGLSPLRPREVWQNPKTDQWELKHPADYRLEREFAPAEFKRNPKTGELGKIVYPNGKAPKDGAPAAKKEDFEICYTSSLLRIRLLQRDKSLADWQIYKALRAALQCRGYGKVPWAAKEARKQGKTAEQLQLEEEKKLQQADPGYRQAVGRWPNFKWDIKKQKLPFFERIQPGKAERVHLQLQDNYYFVPPCYYDAWKMGLWNSDEGIRPSARHDHLATSTHNIRFDRADVRAELVILGDHAAAMLPAVQNAFLRWQREGWKYRHPATGEELIYPIHAKSFGEFLCDGPAGKPDETSFEAFLDQRQHARLHRGSFEEWMAALGQKTPSFDNRILNDCILIPRYHVCKVDVRLETDGDKGVTGKIVSDSLLATEVTLLLKLKNLLVTDAVAGQRKLTVEEVRSISAFAHRQLKSLSLLTADGDLVTGWPQKVADRFAINKSKWEKIAIESEFLGKISAYNISDAGKTRRLTADETELLLRLVSNPKKVLGDELPENLESIFKTAKSDWKKAKALANEKTLRPMPGHEEVKAPKTSGRSGYSRVALRILKELILSGESPSLFHARLLRRDAELLRKLGSSPDKPLELFDNSKATDERQRKLENMENRKRGLLVSELNFLRQMRQDNAAEDSWKDLFIPSQTLDALQQRHTENGKLNTDAAVRELLGNINDPIVRHRLEAFDHRLKKIQFGDQKEKLPGFGKPDAVVLEFVREDFMGEERLKKYQKFLNERAADRKKAKEEATKLGLESRSSGLRYELFKAQGCVCLYTGKPLSETRLDEYEIDHIVPRSLGGPDAVLNYVLTFQEVNHTKEKGKLTPFALLHGKEGWDAYVKRVEARATALRNKKVQLLTREDAPDLVERYTALAETAWVSKLAQTIVNLRFNWTNGYDQNRKKRVIVVSGGLTARVRRKYGLDKLLYKDDTDPEVLAKKLKNRDDKRHHALDAMVLTFIPQWARDPGKEGFFRFPEDFRDSNGREDYEQIRKLFGDHIKKVTPRHLAFERPVLADTIYGRRDNGCVMVKRSQVRSLAYKQEQMKPVFNLKYASGQIEAIRDARIKQELKKFVASEPSQSSWDTYCDKLGNGRLESMPGIKVSKVTLQLDEDPIEFKDLSKDGTGAFRTKKKEHRGQFVYLDSKGKPHAEAVRVFDSVQRVKMAIEAKGKGVHIIGFFQSMCLVELEKPVVHGNITLQPGIYKLNTIKKDGRAQLTSAGGEKSPEIGLVKFLASGFKRVD

SEQ ID NO: 7291 - protein, 1350 aa, unidentified
  REGION 1..1350: note = Description of Unknown:uncultivated organism sequence
MKLNCEETVWAFDLGKGSIGEAVRQGTRFLHKESLLIPAELARRGPATVSGTPASRYRAMKTRQAHRKREEWLEKVWKAAGLTPLQARKPEYVGYQLRRKKKRVRGKSKWKNVKVGGRWILPPSGKADYRLEREFAPKQIEREGGQLVEVKYPEGKAADGAPAATAEDFGTCYTSCLLRIKLLEWKEGERKLAEWQIYKALRAALQRRGYGRVPWATKEARKQGKSAEELEAEEEKKLQQADPRYREAVDKWKQFKSEVPAEFQLPCYYDALHMGLWRYVPEQQQGHLGYWNPENEPAKPPHGSYRTDHKAESTRNIRSDRTAVRAELTRLGDQAAAMLPKLRDAFARWQREGWKFAHPFQEGKQLTYPIHAKSFGEFLCDGPAGQPVERSFEAFLKQRREAGVRRGSFEEWMAGLGQKTPSFDNRILNGCVLIPRYHVCKVDVRLETDGDGKPTGRLVPESLLASEVTLLLKLKNLLVADAKAGQRKLTVQEVRSVFDFAQRRLRSLALLTPEGELVKEWPQKVADRFAINKSHWQAIAAESELLARVRALTVTSKGAAQPLSTEDAELLLRAVATSKKGASVELPEPMKPLLKAAKAEWKKAKDAADQTLLRPMPGHEEVKAPKSSGRSAYSRVALRILKELILSGEAPSVFHDRLMRRDTELLQRLGPSPGKLLVIFNDSTAADEDQRKQEDTENRKRGLLVSELGFLRQMRKDNTAEDSWENIFIPSQTLEALQQRHTEDGKLDADAAIGELLGTIKDPIVRHRLEVFNQRLKKLQFGDEEEAIPAFGVPDAVVLEFVREDFMGEEAKRELKDFQSKREAARKTAREEAQKSGSTEKSAPLKYELCNTQGGICLYCGQPFSRARLDEYAIDHIVPLGEQGPDAMVNKVLAHRECNEAKGKQTPFQWWHHNTTGKAPTISWDGYTALVEKYRTTLRNKKVQLLTREDAPELVERYTALAETAWVSKLAQTIANLRFGWKNGTDYSGPKPVKRVIVVSGGLTARVRRKYGLDKLLYTEVTDAEVLAKKVKNRDDKRHHALDAMVLTFIPQWARDPNKEGFFRFPAAFRNAEGREDYQTIRKLFQQHLAEVMPRNIAYERAALADTSFGCRLDGGKPVIVQRVAVLDLRQKPAGAPGKTTFDLIYLVKQIQSVRDATIRRRLEEFAATNPDEPKWKAFCESFAQKREDGTTGARILKVCVNAAAPDEFKDLSKDGEGAWRKAKGDHQGQIIYTDADGNLAVKPVYVHASIRQELTRIVQTGGKSKVHCFVRSKCLFRLRKELPQPDYRLVIKNEQKQKRRVQATAPLAPGTFMLNTIITASMDVEFSSAGNQRVVAPLQALLVAGFETI

SEQ ID NO: 7292 - protein, 1062 aa, unidentified
  REGION 1..1062: note = Description of Unknown:uncultivated organism sequence
MNIIENHVWGFDMGKGSLGEAVRIGDEFKHVQSLIIDKDFAEIKTAAGLRRQMRTRKAHHAREKWLEKCLADCGIEILKRRKVDIVDGKWTLVSKGDLRLEREFPAYGENVCYNSIALRCKLLLGEKLESWQVFKALNSAIQNRGYDEKLKWDKGDTTKKKDDDSDYAEKLKMYEREKDEMLLNLPDLNERSDFDYPCFFKAFKIGIWSPENPRKVELRITNQAQKAKGYVIPRKCVEEEFVRLVEMASLQYPKLKGKAMFILYGISETPYASLYEPLRKKFNLKRGAETDWTALGQKIPRFDNRIIDKCKLIPRLNVCKIKPLDEAKADEDFLHYDITLALKLLNLRFFRNSSIESLCFEDFKKLFEVGRKNKYKISKTNLKKFFKSISAEVLSEDQSQIEAPRTSGRASFSRPAMKILRELIFSGKTPAEFYEEKLAEISNTDPSKGLIAGDLDFIKLMGDCPWGGIFIPDVETYNYARQIDASADERINKLIGEQNDPIVRHRLSFFYERLKSLSQEFGTPDKIVLEFVREDFMGEKAKKEMNKAIKERFAEKLDLAKKLDESGYKGNKMLLKLELLQKQGGQCIYTGLPLQTSDLPNLEIEHIVPRSRGGPDAQYNYALTTESINKQKADRAPFEWLSADKAKWQEYCARVRSRAKELGKKRCELLLKENAEELVEKYTALAETAWISKLAQRIACLFFGFQFGGNSGTKRVFTVSGNTTSRIRGTFGLNRILHSNDCDRENMSEFDFVKLSKELEEKNRKNKKHHALDAMCLCFTPTARDVKKVDFKTLLPKKIAESATEYFKSYLDKIVPNEVAPKKPRLEDSIYSLRKIQGKNCIVKKFNLVDLAYKSGLKPVYDLNAIAKLLEEKPKKIPPIITPVIRKLIKDFVATNPSEQEWKDWCKDLRIPSKNGEGSRVIRVLVYVGEPDEYKDLSKDGCGAYRKGDAHKGQIIWQTKSGKYKVAPIYVHASKRRILEALKNNPDFEKVAGEFRSHCLVKLDKPAVNDKGEELLADGIYMLNTIRTDGIAILTDPNGIKSPAIGINYLMQAGMRRIKMDY

SEQ ID NO: 7293 - protein, 1017 aa, unidentified
  REGION 1..1017: note = Description of Unknown:uncultivated organism sequence
MAKKVFAFDLGKASIGYCVREGHDIKEANSIIIDKDHAEKVSFRERRRIKKTLDAHKAREEYLDKLWKDCGQEVLDKKDKRFTKEFGGKNDNIIYTSCLLRIALLQNKPLEKWQIYKALHNAIQRRGYDPNVKWATKSADEEDNIKNIEKYTQENGIELIKSDDYKYPCYYDAIRLGLWSENKHDELKTYIPLTNNNKVRATDYVAPRLLVENELTKLWENAQSQISELKKYSVEEFLYGEYREAYGSLVNPDYRQYMGTPNDWQGVLGQKIPRFDNRIISKCKLLPKRNVCKANTIENVTFVLLMKLKNLRFTDVSGEKLRLSPNEIKQIYENWLEKVEKNVEKAKEKTLEFNKADNKLDTTITKKEIENVIERKIIDKIEPMKANISGRSSFCRRACQIMNKIILTGELYPAQMDISEFVDSPDAINGITEEEIKTMLSRVGDWNNLYIPDNRDENAKMASNSRIKTDIMIGNITNPIVRNRLQIFRDLIMDLAEKYGKPDEVIFEFVRDGADNSLFGKVKASKAEAYMKLQEKENEQIKKELEDADALNGKYFLMHKLLKMQGGKCIYSGEKIGISDFPNCEIDHIYPRTMGGNDALYNKVVCFRSQNQLKEGRTPYEWLSHDEEQWANYVNRLNKIKGSLGQKKYELLTSKPEDCEKLIESYNGLAETSHIARVAQQMTAFIFGWGLQVEGEHRHIFVNNGASTFAIRKRYGLNSFLGDDAKKNRDNDKHHALDAICISYSRDFKYNKELDKDVIDGFNPIKVKEVIDSIMPYPYANKKPFKGNTRPDATIYGIRQIGGKNYITNRVDLIKIDQKESKIKNIIDETIKSDLLSKLEDKMSVNEWKTMLENYVHPKKKTRVKKVMLIVSEGKLEKDSNGRERIGEFVDFANYKKGHTRHQFKHSKGHKGQILYYNEKGSVKVMPVYSNKKTQEVKDKLEQMGCKLYNRGEMYYSGCLINVPNEFFAGKVTCPAGIYKVRTITEAGQIKLENNTGNEILSSAVNLSNAKFSKYKD

SEQ ID NO: 7294 - protein, 1111 aa, unidentified
  REGION 1..1111: note = Description of Unknown:uncultivated organism sequence
MALDWFQYEESLDGNLVTLLFLVILISTNYVSVMSFSLSFDIGHSSIGWAAFKFPKNQLEILGCGVVTFPAEDNQNQQRAGFRRQRRHIAATRNRIKRLEAFLVQAGALSVEDVEYCRENPNPWPWLLAAQVIVTNRGLNWRELWPVIRWYAHNRGYDGNALWAGEDSDPDDVKKVQTARELMEKNNTSSLCETVCKLMDIDLKVQKNPKLRHYFKGENAAFPRDVVVAEVRKVLERHLGILDGMTQELIEALLDDWKRVSEVGFDAKLPARYFGGLLFGQMKPRFENRIIPNCRVTGEKTPSKHSREFYRFRWAMLMGNLRVADPFEGGSRALSPTEREQLNVAMATSGYLTKTTLKKVLVKDLNLEPTNLDAMLLIPEMEKALVLDPALREMSGTKYKKIWKEIPNTWHSALLNQLFNGRNYRSKPASLAQWRSRIESKGALSVELDSALTDAYDSECKLLAKKKGVGELPSYEAFLNRSLRIAPSNMASGRAPYARVKLIEAVEAIMKGEDPRAVGGVLEETASVRQRQQKEGVDQNSNNHLVRHRLKIFEKTLIDLVNRYADGDASQVEWVGVEVVRDMVEFSGKTAKEKAKIIGEQLWHHRKISKYLEKEREAAGGSWEITAGLIKKVRIADDMGWKCPYTGKIYNLNQIIHGDVDREHIIPRSKRPTDAMHALTLTFSTINKEKGARTAMQFIEATKNDSRTLTPKQFYEFVSKLKKSNGPSKDDERRCMKRKVALLTRDYEPRGKAKEKSEETAIDGFTEGSLTQTSYLNKLAAQRVHHWFSEQLEDGSKLPKVMQLSGSVTAATRRGWNLLSPLEAACPETRGKSKTEIREITHLHHALDAIVIGLSAHYFPLDGRLWTLLSKRSIKDPSAQAYMRAQLGDLISFSSSGSWQLEPLEDSLISQIVERLKEKRVVRHNPRTMRGLRVQQNVWRVEDEAPDDPSKMLIRMKPRNEDGDKVLKQKSERKTKLFGSDPKDVTGKLKDLKGVLIVEDNYGMALDPEPKVIPYQQVWAQLQQLKKQNGGRTVRVLRNGHIIRVQKGRYRGLWRVHSIKDANMGLVLDIASPELVRVSNGVVGAKLNVRLKTLLSNGLELLNLDSSSHEV

SEQ ID NO: 7295 - protein, 1087 aa, unidentified
  REGION 1..1087: note = Description of Unknown:uncultivated organism sequence
MNIKDKNLHRTEAHLHVSFDVGHSSIGWAVLQTGEPLEIKGCGSVVFRTDDCLSSSRRVYRRQRRHIRSTRQRIARIKILLKHLGLMTEADLDKPGCAWPWKLAAQVLQGDELLTWPELWDVLRWYAHNRGYDGNRRWSAAETEAQTEDSEKEVKAHSLMDKYGTKSMAETFCAICGINPLDKKKSANMSGDKRPKGQNAAFPREIVECEVRQILQKHFGTLKNVDANLERVLLGRDSNDKLAWQAISCPELKLPKRYEGGLLFGQLVPRFDNRIISTCPISGQKVPSRNCPEFLNFRWAMQLANIRVGKKADRELRRLSGAECVSLNNQMHERGYLTPGQLKEAVRSVTGCERDNLETMLMHPDSKEALIVDPVQKLISSDDLHPFWMLLTERLQKRLRGKWHRGKHVSLAQIRTQLKPLGDITAFDAELQRQIDTQNTKTKKKDKPITLDELLKKTFPSRPLKMDGRAAYARHLMQRAYEDVLAGKPHPKEEGGCLFITEEIREAQINRAIADQTNNHLVRHRLVILERLLKDIVKEYADGNKTRIGNITIEVNRDLREMSGKTAKEKAQDMGLRIANHHAVATKLEKAFAEEGIRQPITAGLIRKARIAEDLGWKCPYTGQTYEPKNLITRLVDKDHIVPRSERASDSLDSLVITFSAINKWKGKRTAWQFVTEEQGKPIPDMPQLSIMSLSRYKQFVDGLETYKGHDDDKRRKKKRKELMMLLKYEEKEFTPRDLTQTSQLVRLGAQVLKRTFADCKEKPMVTSLPGSVTGAVRKAWKVLGCLSLANPQVLDENKTVKCKTDIRNITHLHHALDACVLALSAHFIPNNGRIWELIVKRNLNDSEKRELEALGVFGFNAENRFEMRDLDNRLKDQIRDRLAEKRVVQHIPARMDGLRVEQNTWGVVAKHEDGTAIIRQRIRQPNGTRPEKVTEEKTGKLLGLNPINGNGKLAKNKGALVIPDNYGVALDPQPTVIPFHKVWTRLQELKKANGNKMPRILRNGQLIRIVRGSRAGIWKVLSTKDTKAYGIALDLALPDRVKLDRGNAPIKTLIQDGLEILDCSFVGIDSSKITITEAKKRPRKPK

SEQ ID NO: 7296 - protein, 1156 aa, unidentified
  REGION 1..1156: note = Description of Unknown:uncultivated organism sequence
MNAKGKISSATAADLELDFDAGHSSIGWAVLRAHTGQTPALLGCGSVIFPADDCLASVRRGFRRQRRHIRATRLRIARMRRLLAHLAVLTTEQLETPGCAWPWLLAARVLRGGDRLSWAELWNVLRWYAHNRGYDGNKGWSKHGVTSNEDSEKETRANELLAAFEKTHGRAGTMAEVFCDVLKVDPLGVVKSSMQRVRNLGAAFPREGVECEVERILRAHVGLLTNLDDRFINALMRDHTALPGPDLRLPARYGQRLNDGSFSPGGLLFGQLVPRFDNRIIARCPITFERVYQSVKAKTDDEEQAKKEAEKQAKVPGVDCVEFHRFRWAMELAKVKVANGNAREPRNLTAAERQAVNVEMEKRGHLSPSELKKAVRAQTGGAPDNLEQILTHPDAERALVLDPVRRYLHSDQLVCALWPVLPERLQKRLRGQWRRGHAITVAELLDACGESRAAAEALCQRHLDRQNTKKRKKDEPLTREALLRTPLHVQPPNGRAPHTRQVMREVVEFVFATDRHPAEEGGPLYRSEAIRQAQLQRALDEQTNNHLVRHRLKILERLHADLLKEYAGGDRARISRITIEVNRDLREMSGKTAQAQAKLQGQQLAHFKSVAKKLAEAYEGLAVHVGPSLIRKGRIAEDLGWTCPYTGKPYDALDLLHRRVDKDHIIPRTNRASDSLDSIVITFSEINRMKGNRTAVRFVEQFQGQPVQGLPQVMIKPLSAYLKDVAALETFKGHDDDQRRKKNRKRWLLMRDYVEKEFTPGDLTQTSQLVRLGAQTLQKHYLGAEKQPVITSLPGSVTGAVRKSWNLIGCLATANPRVLNPDDLDEGGRPKVHTKTEIRGITRLHHALDACVLAFASHFLPRDGGAWELLVKRRLNADEQRRARTLFGSHIEITQDGELRLADLTPSLKAQICERLKEHRVVQHLPADLSGLRCKETVWRVFDPADPHPNSKRMARWLAQKKVAVPAPDAKTALIICRKRRAADKTGEESAGGKAFRETKTWCWVYDIKDKSALLGLAPEGDAAAAKLKRIKAVKVLGDNFGLALDPEPTLIRPHKVWHKLHDLREKNGGKPVRVLRIGSLIRVLEKGKQSDYRGVRMIRGVQLNQKSGFLVDLSPADQILYRGQPGCFQQVSVATLLKCGLEILKAPLCGVTPSE

SEQ ID NO: 7297 - protein, 1201 aa, unidentified
  REGION 1..1201: note = Description of Unknown:uncultivated organism sequence
METRGILDELGNLQFAFDVGHSSIGWAVLRRAAPPPALPEILGTGVVIFGADDCLAVKRRQYRQARRHARATRQRIVRMEQLLAHLGVMTTEELAERHDQAGGDSFAWQRAAALLAAARTGQPLPATTWPELWDILRWYAHNRGYFAPPWADRSEEDALDDDEVPDTEKVANAGELMRERHTTTMAETIAAYTAWYDREVARWQQGQRPDKPRHFKGRSAAFDRVSVVWPEVRALLTALKGTLPKLDDTLIRTLLGNDVDPLKDRDAWRTIPCPAIRLPKRYHGGLLFGQSIPRFDNRIIGVCPIQFARLEQQYREAGMAPDDARRRAEKESKLPTKASPEFLRFRWAMQLANVVGAALGVRESHPLPAAARVRLTELAARQGAFTKGEFKKAVREAAGWPEKGGRDNLDALLLHPDAEEALVFDPVQAALRKHPLADALLALPPQCLKRLRGKLARGKEVKPEAVRDWLGEAQAPRLQPTAPPPSASDPLAAFDAAVQRVLDAANTRKGRKQSALTRDQLLDEPLRANYPKGRAPYARPVLRQAYEEVMKGWDPRAEQNDLQPRGCLCQTDELKEAQLHRRLAEQTNNHLIRHRLLILGGEPPKANAKPEQERRRFKGLLHDLVQEFANGDQSRIAGLTIEVNRELRDLSGKDREAQKKELGAKLGDFKRVAAKVEEACRRRGIPCTAGLIRKARVAEDLGWKCPYTGKEFSVDTLLDGVMDKEHIIPHSDRQSDSLDSLVITWKEINLWKGKRTAMEFIRDEGGKAVPGLRGVEIMSLAEFQKHVASLDTRKGHDDDRARKKRRVRRLLTEHYEEKEFTPRDLTVTSHLVRLGAQVLQRAYPPGQRPRVISLPGSVTGEVRKAWKLIGCLGAANPAIFEADGKTPKRKDDIRGITHLHHALDACVLGLASLYFPRHGAVWSAMVKAGGDPEADDDRRLWLAMTKRRPSTAEAALLKATGLYQPDSEGRLHLNDLPDALKQQIRQRLAEKRVVQHIPADMSGVKVEENTRGVVAVKDGRVVLRQRSGRDAKTGLQVVKTTDEAPGKLLGLNPPGGDGKLKRQKGVRVITDNFGVAILDHAPEGEEKFVVIPWHRVWHRLNELKARNGGEAPRVLRNGQVVSITSGTYAGRWRVFSIKAKQAGIKVNLGTLDCLGVEEDYLDPATGKKRTRTVAGCKLDAALPTMVKGGLKVLKPRFCGTP

SEQ ID NO: 7298 - protein, 1145 aa, unidentified
  REGION 1..1145: note = Description of Unknown:uncultivated organism sequence
MKTNSTAPGPDLELAFDVGHSSIGWTVLQSPPGALPSPPNLLGCGVVTFGADDCLASKRRDYRRQRRHVRATRQRIRRLKTLLAHLGVLTPAQLDQPGCAWPWLLAARVLRGGPLLSWPELWDVLRWYAHNRGYDANRRWSSQDPADAEDAEKVQNARALYDKHGTHTMAETFCAVSGLDPLGDKKSCNLPGALRPKGLNAAFPREDVEAEVRRILERHRGVLAGVGDAFIRTLFEDWRAIPCPAIALPERFRGGLLFGQLVPRFENRIIATCPITFERVFQQVLAESGNAAQAAAAATKQAKVPARECPEFYHFRWAMQLANVQIATGRGRETRPLTLDERKQIHAQMRERGFLTPAEFKHAVRKRTANAPDNLDQMLLHPDAQEALVLDPVKKLVTTQPALATVWKSLPVPLQKRATGQWRRGKTLRLRDLIAAAGEPARAQIDAALRDYVTAENTKKKRKDQRLELDELLATPLSIQRLKGRAAYTREVLRQAWTDVMERGIHPKEAGGCLFRDEALRQAQLQRAIDQQTNNHLVRHRLRILERLHQDVLREYAGGNPARVARVTIEVNRELRELSGKTRKEQEQDLGLRLANFKSVVKKLEADFAGKDIKITPGLIRKARVAEDLGWTCPYTGKGYDSFDLLYRKVDKDHIIPRSDRASDSLDSLVITFAEVNKMKGKRTARQFIEEFQGRTVEGAPNLMIRSVRDYEQWIDDLDTFKGHADDQRRKKRRKDLLKLRDYVEKEFTPRDLTQTSQLVRLGAQMLQRAYLAVPHPPAITSLPGSVTGVVRKAWNLLGCLSTANPGVLDEHGEVRTKTEIRDITHLHHALDACVLGLTAHFIPNNGRVWQLLTKRESSLTEAEQRELAALGVFARDSEGRFRLRDLDHTLKEQLRQRLAERRVVQHIPADMTGMAAEETVWRVFDPADPHPSARRLARWFKAAGVDVPAPDADTVLITCRKRRSQPGADSGKTLHATATWRWVYQEIARSKLIGLEPAPGSEGRLKKLKAVKILGDNYGLALDPEPQVIRFHKVWPQLQELRRKNGGKPVRVLRNGQLIRVPRGRYQGVWRVMSAKANLKLDLAWADATKMKSSGIDVRGNVLVSTLFRDGMEILDCPYIGVAACPTTPAASEPKPNRHGTGWS

SEQ ID NO: 7299 - protein, 1140 aa, unidentified
  REGION 1..1140: note = Description of Unknown:uncultivated organism sequence
MKNTGDLHLAFDVGHSSIGWAVLRQEPNVKPPNPEILGTGVVTFGADDCLAVKRRKNRQARRHARATRQRIGHIEKLLAHLGVMSADELKAHHDQGCGDSFSWQKAADILAAARTGRPIPEIRWMELWEILRWYAHNRGYFAPPWANRGDDTAKDSGDDVPDTEKVANSHSIMQEFGTRTMAQTIAAYTGWYEKEIVKWRAGERSNKPPHFKGLNAAFERESVVWPEVFALLSALKDRLPKLDDDLIRTLLGSEPDPMADPEAWKAIPCEAIKLPKRYMGGLLFGQMIPRFDNRIIGVCPILFARRQAELIDDGYSAEEAKHQAEKESKLPAKATPEFLRFRWAMQLANVFGACDREKATRLLTGEERKALTTQAADAGAMTKSTFKKAIRELTGWKRDNLESMLMHPDAEKALVLDPVQNEIRKSILVDAFSQMPDRLRKRLNGKLARGKSVSLQEVRDWLEGDDAAQFDAEVDRLVTSANTRKNKKQTATTRESLLKEKLSAPFPTGRAPYSRTILRQAYDEVMNGWDPRAEKNDQQERGCLCQTEELKEAQLQRRLEEQTNNHLVRHRLLILERLLGDLIAAPEFANGDASRIAGITIEVNRDLQAQSGKTRKEQEQDLGRRLGDFKTVAGKVEEACKRRGMPITAGLIRKARVAEDLGWKCPYTGKAFDIDSLLDGTMDKEHIIPHADRQSDSLDSLVITWTEVNKWKGKRTAMEFIREFGGQKVPGRTELTIMPIGEFKKFVDGLNIKKGHADDQARKKRRVRRLLTEHYEEKEFTPRDLTVTSHLVRLGAQVLQRTFPPDQRPPVVSLPGSVTGEVRKAWRLIGCLGAANPAIFQADAKTPKTKQEIRGITHLHHALDACVLGLASIYFPKHGELWKAMIQRRPDPGQQALLRSTNLYRADSEGRMRLAELPDGLKHQLRDKLAEKRVVQHIPADMSGVKVEENTRGVLLQKDGGRVVLRQQAPRDAKTGVRPEAKETEEAAGKLLGLKPTSGQGKLTREKGVRVITDNYGVAILDHVSSPDERFVIIPWYRVWHQINELREKNQGKPPRVLRIGSVVRVTAKSGRADYRGLWMIRGAQLNQRQGFLVDISAPDVITYRVSGRSDCFQNVRLKALVDGGLEILKPTLAGLPLKT

SEQ ID NO: 7300 - protein, 1130 aa, unidentified
  REGION 1..1130: note = Description of Unknown:uncultivated organism sequence
MNTTNPIPDLEMAFDVGHGSIGWAVFQNGSPAAFSGLNLRGCGVVIFGADDCLAKQRRDHRRQRRHIRATRQRIRLLWELLAHLGVLTPQQLERPGCAWPWFLAGRVLRGGSLLSWPELWDVLRWYAHNRGYDANRRWSRQEPDEREDAEKVENARALYQKYGTQTMAETFCAVCGLDPLGSRKSSNVSGPQRPRGLNAAFPREDVEAEVRRILERHSGHLPGLSRELIEALLQDWRAIPCPGIVLPARYQGGLLFGQRVPRFDNRIIGTCPIIYERVYQQVLAASGDSARAAASARKAAKVPSRNCVEFHRFRWAMQLANVQVATGPGRQTRPLTVEERGRINKQMEQRGFLTPAQFKDAVRQLTGKAPDNLDQMLMHPDAQETLVLDPVKKLIRTDDALKMIWPGLKKRARLRAVGQWRRGKTLRVRQLLAALNEPSAAASSVEGEQQLCAPGSRRMDKNKSPNLQTLLDQPLSIKRLKGRAPYTREVMRQAWEEVLQRGLHPKEQGGCLYRDEAIRQAQLQRALDEQTNNHLVRHRLRILERLHADILREYAGGDRARVARLTLEVNRELREFSGMTRKEQEKELGQRLAHFKSVVKKLEQDLAGKDIKITPGLIRKARVAEDLGWTCPYTGKQFEALDLLYRKVDKDHIIPRSDRASDSLDSLVITFAEVNRMKGKRTALQFIEQFQGRPVEGTPHLTIRTLGDYKQWVENLDSWQGHLDDKRRKKRRKELLLLRDYVEPEFTPRDLTQTSQLVRLAAQVFQREYLGLEKPPVLTSLPGSVTGLLRKGWDLPGCLVTANPQVLDTNDQVRTKTEIRDITHLHHALDACVLGLTGHFIPRDGHIWQLLVKRDGSLSPGERQELLRLGLFDSDSAGRRQLRDLPTPLKEQLRLRLAERRVVQHIPADMTGLPAEETVWRVFDPTDPHPSARRLARWFQAAGVAVPDPQADSVLIVCRKRTSEPGAGAGKTLHQTPTWRWVYDEVSRSKLIGPDPAPGSPARLKRLKAAKILRDNYGLALDPEPRIIRFHKVWHQLQVLRRANGGTPVRVLRTGQLIRVPTGRYAGLWRVFSVKAALTLNLGAPDKVRLESKGPGVKRDVRLKTLLHDGLQLLEPPYTGIAACPTTSST

SEQ ID NO: 7301 - protein, 1157 aa, unidentified
  REGION 1..1157: note = Description of Unknown:uncultivated organism sequence
MQSNKKIEEANQDLEIAFDVGHSSIGWAILQDTNHSDPGDDGFATPKLLGCGVVTFGADDCLAKKRRDYRRQRRHIRATRQRIARLKELLKHMGVLTQQQLDKPGCAWPWLLAARVLKGGPLLTWPEMWDVLRWYAHNRGYNANRLWSRQDDADAEDSEKVQNALHLFEQYKTNTMAETICAICGLDPLGNKKSCHLTADRRPKGLNAAFPRENIENEIKRILQQHIGHLPQINELLIKALLEDWRALPCPVIKLPPRYRGGLLLGQLVPRFDNRIIKSCPITYEREYQRCLNNSEDSEKAAQQAAKASKVPTAKCPEFLCFRWAMLLANVKISQAGNGHLRSLTIKERAEVHCQMEQKGYLTKEEFKGAVRQLTNNMPDNLDQMLMHPDSEGALVLDPVKKVLSQEPWATLWSQMSPRLQKRAIGRLRRGKSISLSELAGAAPDLKEECDRLRQVLQEYVDGQNTKKKRGKEISIDQVWQQSFEAKLPKGRAPYTRQVMREVWQDVMEKGIHPKEKEGCLYRDEAIREAQIQRSIDQQTNNHLVRHRLKILERLHKDILKTYATDNPARVKRITIEVNRELREYSGMTRKEQEQDLGQRLAHFKSAVKKLENDLKEADIQKYNIRITAGLIRKTRIAMDLDWTCPYTGERYDVLTLARKGVDKDHIIPRSQRASDSLDSLVITFPEVNRMKGKRTALRFIEEFQGRTVEGRPNLTIRTVQQYKAWVEKLDTRLGHLEDQRRKKRRKEMLLLSEYVDKDFTPRDLTQTSQLVRLGAALLQRPYLHLEKKPVITSLPGSVTAFVRRAWNLLGCLSLANPQVLNEEGHVKTKDEIRGITHLHHALDACTLALAGHYLPRDGHIWSLLVKRRLNPMEQRQLVQATHGLCQITADGEVTLRDLPTSFKEQLRQRLAERRVVQHVPKDMSGLPAEETVYRVFDPADQHPSARRLRRWFDAQKVKIPGPDDDTVLIVCRKRKTSADSQTGTILHETDTWRWVYKEVEKSKLIGLNPEPNSKGKLKKLKAVKIISDNFGIALDPEPTIIRFHKVWHQLQALRHQNHDKPIRVLRKGQIIQIHNGTRAGIWRVFSVKDTEAYGVAVDLSLLDNPGLNRGNAPVEKLLIDGLSIINCPLVGIDSSKIQMAPVKKRLRKSKKNTANE

SEQ ID NO: 7302 - protein, 1084 aa, unidentified
  REGION 1..1084: note = Description of Unknown:uncultivated organism sequence
MVASKNPARLELSFDIGHSSIGWAVLSIPTATPLPDILGCGVVTFEKDGALANQRRLHRSQRRHVRATRLRIARMEKLLAHLGVLTAEQLAAKHQASGGHPVPWLLAARVLASDGAQLLSWPELWDVLRWYAHNRGYEEIGSEASADDAPADDEKAKDAEKVANAKAAMSRLGKSTMAETICAWLGLDPLGERRPTHENYKAKNSAFERPVVIAEVRRILAAHRGKLPALDDAVITALLDDARVLSIPTIRFPKRYQGGLLFGRLATRYHNRIIGRCPISGEKIPSKNCPEFLRYRWGMQLANIRVGTDAKGDLRPLSIEERKTLHAAMTSAGHLSVKALKETVRSLPGVVRDNLENLLLHPDAKEAFIFDPAQKLITSHPHLSAIWPHLPERIQKRAKGRWRHGKSMTLAVLRSEAAALGHDLTAFDAALSALLSPDAKKPKGKKAATLTREGILSAPLDIRRDLSRLSGRAPYARPLLSKAFDEVMAGNDPKAKGGCLEETDEVRRRRETRPIPEQTNNHLVRHRLLILGRLLRDLIADKSYAAGDPARINRVTIEVNRDLREMSGLSAQDIAKELGARLSNHKKVSARLEKDLPEGTPITAGLIRKARIADDLGWRCPYTGVDFEPVDLIEKRVDKDHIIPRSQRPTDSLDALVITFNTINRWKGKRTAWQFIEDEGGKPVPGAPHLSIMPMNRFKEFVEKLDARNGHEEDRRRKKRRKEFLLLEKYEEKSGGFTPGQLTQTSQLARLAAQVVREPFTGIKEPPTIVALPGSVTGTVRRSWDLLGCLSAATPAVLDSDGSVKTKTEIREITHLHHALDACVIGLAAHFIPNRGDVWRLLSERRLRPEQQAQLVEALPTKLLDFDAQGGFRLRDLPDELKQQIRARLTERRVVQHISRDMNGLRVEENTRGVIRRENGRVFLRQQKRDADGKRIINETNEPEGKVIGLPPLGHTGGKLAKLNGVRVIADNFGVAILDDEKLPPEDRFVIIPFAHVWKRVAELKTRNGGKRPQIWRNGQIIELKKGKRAGLWRIFSIKNNTSGMALDLGPIDAVKPIWINCLLKSLLRDGARRLNTTFSGADI

SEQ ID NO: 7303 - protein, 965 aa, unidentified
  REGION 1..965: note = Description of Unknown:uncultivated organism sequence
MLASNGEHALTWSELWDVLRWYAHNRGYEAIGADEDEAENKEKRAHAREAMERFGKNTMAETICAWLGQDPLAPRSGTTESYKAKDAAFDRAVVVDEVRQVLAHHTGKLPGVDDAFVRALLEDAHAIVCPDIRLPRRYRGGLLFGRLATRYHNRIIGRCPISGEKLPLKDCPEFLRFRWAMLLANINVASASDQSLRPLSKEERSALTQQATTKGYFTPGEFRKTVRALTGSVRDNLDQMFMDATAAENLVLDPALRLVSTNRWIAAVWPHLPEIVQRHALNRWRRGRSQTLGKLRDEAIRRGADISAFDAAVAQLCSVPEKRSGKKTPTPPPTAAQILTTSFTVPPLGGRAAYARPLLLSTYQQVMSGTVHPRSEGGCLFETPELRRARDNRPLDQQTNNHLVRHRLQILGRLLQHLIADYAGGDASRVQRITLEVNRDLRAMAGLTAQEIAKEMNERLRNHAQVSKRLLAELPQGTKINASLIRKARIADDLGWRCPYTGHDFEPIDLITRRVDLDHIIPRSQRPSDSLDSLVVTFSEINKWKGKRTAWEFVRAEETKTVPGLPNLQIKQLSRYKQDVEALDKRGHLDDQRRKKRRVEKLLLERYEEKAGGFTPGQLTQTSQLTRLGQQVLRAPFAHLPSPPTFVALPGPVTARIRAAWDVLGCLAEAAPAVLEKSVDTEGNERIVVKNKTEIRQITHLHHALDACVLGLAAALIPNQGDVWRLLLERRLNTEQRGALEKLDLGDFDANGGFRLRDLPGDLKQQIRDRLAERRVVQHVPADMSGIRVEENTRGVISRENGRVTLRQRKKNADGKIVTNCTTELETKVIGLNPDGKLSKVRGVRVIADNFGVAILDNPEIPPAERLVIIPFARVWAQLGALKQRNGGKPPLIWRNGQVLKIPAGPRAGLWRIFSIKNNASGMALDLGTVETVRPSWINVLLKSLLRDGALRLNTDLTGRAFPQD

SEQ ID NO: 7304 - protein, 1083 aa, unidentified
  REGION 1..1083: note = Description of Unknown:uncultivated organism sequence
MQNDTAQTSSASRNSAPLSFAFDVGHSSIGWSVLTAPASGMPDILSCGVVLFEKDSALAIQRRQHRQQRRHIRATRQRIARMERLLSSLGVFSAEELKSKHIANGGSPTPWLLAARVLASNGQQTLNWPELWDVLRWYAHNRGYEPIGADEDEEENKEKRAHAREGMERFGKQTMAETICAWLGQDPLAPRSGTTESYKAKDAAFDRHVVREEVRRLLTSHIGKLPCIDEDFIRALLDDAQPKPCAGIRLPRRYTGGLLFGRLATRYHNRIIGRCPISGAKLPVKDCPEYYRFRWALLLANITVATAADSPLRELTATERAELTKIAERDGYFTPAEFRKTVRTLTGAVRDNLDQMFMDATAAENLVLDPALKLATTNSWIGPLWLHLPENTRRHALNHWRRGRTQTLADLRSKAASSGADLTGFDSALAQLCTAPARKSRKKEPVPPPTADEILSTRFAAPLIGGRAPYARPLLIQAYQQSMQGRHPRAEDGCLFETPEQRRSRDQRTIDQQTNNHLVRHRLQILGRLVAQLIADPAYANGDAARVERITLEVNRDLREMAGLTAQDIAKEMNERLRSHAQVSKRLLAELPPGTRINASLIRKARIADDLNWQCPYTGHDFEPVDLVTRRVDLDHIIPRSLRPSDSLDSLVVTFSEINKWKGNRTAWQFVADEETKAVPGLPHLHIKQLRRYEEDVRAFDKRGHIDDQRRKKRRIEKLLLARYEEKGGGFTPGQLTQTSQLARLGQQVLRAPFTHLAQPPVFVALPGPVTARVRAAWDALGCLAEAAPGVLEKTKDADGREHFVVKTKTEIRNITHLHHALDACVLGLASALIPNRGDVWRLLLERKLKPDQRADLEALNLGDFDANGGFRLRDLPHSLKQQIRTRLAERRVVQHVPADMSGLRVEENTRGVLKRENGRVFLRQRKKNTNGEFVVNRTDELESKVVGLNPEGKLAKIKGVRVVTDNFGVAILDDEKLPPAERFVVIPFARVWEQLETLKARNGGRSPQVWRNGQVIKLPKGPRAGHWRIFSIKNTSNMGLVLDLGTVEAIRPTWINVLLKTLLRNGASRAITTLAGSEARNA

SEQ ID NO: 7305 - protein, 1081 aa, unidentified
  REGION 1..1081: note = Description of Unknown:uncultivated organism sequence
MNATTKSPDTNLELAFDVGHSSIGWAVLQHTNGSATVPVASSVNILGCGVVTFRADDCLASTRRSYRRQRRHIRSTRQRIARMKRLLLHLGVLTEAQLNSPGCGWPWKLAAKVLVTGGQQTLTWRELWDVLRWYAHNRGYDANRRWSRGDAAGEDDDTEKVETAKSKMKEYGVQTMAETFCRYLGIDPLGPKLSSTARFKGLNAAFPRELVVDEVKRILEAHFGKLNGANETLVKSLFTDWRATPCPSIKVPKRYQGGLLFGQLVPRFDNRIIAKCPVTGEKVPSRNTSEFLNFRWAMQLANVRVGKSGNAEFRALTPEERKKVDAVMRAQGRLTEKEFKKAVRDTTGTERDNLDALLLHPDAKKALLLDPVQDCISSSRLQAVWPKFTPRMQKRVRGQLRRGKLLTLATIRADMERLGEAIASLDGEIQRMLDAAAARGSKKSKLLTRESLLAEMFQAERLDGRAAYSRPVLQKAFDEVMAGTHPKEEDGCLFVTEQMRQAQLQRSLAEQTNNHLVRHRLLILERLLRDIIKEFANGEKSRVGKITIEVNRDLREMSGRTAKEKAQDLGRRIADHHRVAEKLEEAFKGQRFSGQPIRVTPGLIRKGRIAEDLGWTCPYTGQKYEPIDLVTRKVDKDHIVPRSSRLSDSLDSLVITYSTINKWKGKRTAYRFVEQEQGKPVPDLPNQMIVSLTRYKGFVEALDVKKGHGDDQRRKKNRQRLLLTPSYEEEEFVPRDLTQTSQLVRLGAQALKRGFSGLDNPPTMVSLPGSVTGVVRKGWNLLGCLTQACPQVLDEAGDVRTKTEIRDITHLHHALDACVLGLASYFIPSNGSIWQMIIKRKLDDGEKLQLRGLGIFDFDSEGRFGLREAPDAIKAEIRKRLSEKRVVQHLPKRTTGMPVDQNMWRLRGWNDKGKAILEKHSRDASGKRKRDNPKAGADSKDRLVGWQPENGSGKLQRLKAVLISNENFGVALTQPKPVIVPFHKVHKRLEELKHSNAGKMPQVIRAGALVQIPKGTHNGSWRVFSIKNNANGVAFALGQRDALHPDPSKQNVLVRQLEKDGMVVQGTALTGIPVCPTTSSA

SEQ ID NO: 7306 - protein, 786 aa, unidentified
  REGION 1..786: note = Description of Unknown:uncultivated organism sequence
MQLANARVTRFGEKELSPLTASDRQQVDSVMRQRGGMGVEEFKKQVRQAAGAIRDNLDTMLLHPDAKEALLLDPVQKLVQSSEFKPFWQLLPGRLQKRARGQWRRGKTITLARFRSQLEELGLSPASFDAEVAKQLDAANTKGRKKDKQTSREELLSRPLSVNRLDQRAAFARPLLKRAFEEVMAGKHPKEEGGCLFVTEEMRRAQMTREIAQQTNNHLVRHRLLILERLLGDIIKEYAGGDKTRIARITIEVNRDLREMSGMTAKQKAQDLGLRIANHHHVVKKLEEDDSLMKVLQKRGTRISAGLIRKARVADDLGWVCPYTGQRFEPVDLITKRVDKDHIVPRADRASDSLDSLVMTFSAINKWKGKRTAWQFVEQEQGKPVPDLPNLSIMSLSRYKQLIESLETFRGHDDDKRRKKRRKEWMLLPTYEEKEFTPRDLTTTSQLVRLGAMALRKAFVGCTRQPVVVSLPGSVTGVVRKAWKVLGCLSLAAPQILDENREVKTKQEIRDITHLHHALDACVLGLAAHFIPNNGRVWELIVKRQWTPAEERELKALGIFDKDAEGRFQMRDLHNRLKEQVRQRLAERRVVQHIPARMDGLRVEQNTWRVVSVQDGEAILRQRVRAADGSRPGKTTQERVTKLLGLRPANGMGKLQANKGALVIPDNFGVALTNPDPVIVPFHKVWPRLSELKARNGGKVPRILRNGQLIRVPGGKKFKGVWRVFSAKNNAKGIALDIGSPDVVRLKNKTEGHKINVRLATLIKDGMEVLKTPLTGLAACPAASSG

SEQ ID NO: 7307 - protein, 867 aa, unidentified
  REGION 1..867: note = Description of Unknown:uncultivated organism sequence
MRQILQKHFGQLTGVDTNLERTLIGTNNRDEKAWEAIPCPDLKLPKRYQGGLLFGQLVPRFDNRIISICPISGQKVPSRNCPEFMNIRWAMQLANIKIGRARDRALQPLKAEHRLALDQQMRVRGYLTPGQLKDAVRELTGCERAHLGTMFMHPDAKEALLVDPVQKLVSSDELQPFWKLLPERLQKRLRGQWRRNKSFTLAQIRQQLEPLGEAGLFDLELQRQLDAQNTKSKKKDKPATRDELLQKRFPSRPLKLDGRAAYARHLLKQAYAEVLAGRPHPKEGGGCLFLSEEIRQKQLNSEIAEQTNNHLVRHRLVILERVLNDIVKEYAAGKKERIAKITIEVNRELREMSGLTAKEKAQDLGLRIANHHAVAEKLEMAFAEESNGQSISITAGLIRKARIADDLGWKCPYTGIQYEPKDLVTRRVDKDHVVPRSERASDSLDSLVITFAAINKWKGKRTAWQFVSEEQGKTVPDLPNLSIMSLTRYKQVVEGLETFKGHVDDKRRKKKRKELLLLPKYEEKEFTPRDLTQTSQLVRLGAQVLRKHLPHLTTGDVTSLPGSVTGTVRKAWHVLGCLATANPQVLDENSKVKSKTEIRDITHLHHALDACVLGLASHFIPNHGQVWELILKRSLNDLERRQLAALGVFGFNAENRFEMFDLADRLKEQICQRLAEKRVVQHIPARMDGLRVEQNTWRVVAQKDGEVILKQRMRQPDGTRPEKVAEEKPSKLLGLKPVGGSGKLAKIKGALVIPDNFGVALDPQPTVIPFHKVWIRLQELKNANGGKMPRVLRNGQLIRVKEGKFKGVWRVFSAKNNATGMALDIGSPDVVRLKNKTEGHKINVRLSSLIKCGLEPVRASFTGVASK

SEQ ID NO: 7308 - protein, 1081 aa, unidentified
  REGION 1..1081: note = Description of Unknown:uncultivated organism sequence
MNGKGKVLAAKPNFGIAFDVGHSSIGWAVLQTEGRAEIAGCGAVTFRADDCLASARRGYRRQRRHIRSTRQRIARMKVLLKHLGALKPEQLDQPGCAWPWQLAARVLCGGKLLTWPELWDVLRWYAHNRGYDGNRRWSAADAEAIADDTEKEENAKTLMGKHRVGSMAETFCMELGVDPLGQKRASTVRFKGLNAAFPRAIVEGEVRRILQAHSGKLPKVDAALERALLGRDNRDRTAWQSIPCPALRLPKRYEGALLFGQLVPRFDNRIISKCPVSGEKVPSRNCAEFLNFRWAMQLANVRVARFGEKELTPLTAPERRQLDAAMRKQGGMGAEEFKKHVRQAAGAIRDNLDTMLLHPDAKEALLLDPVQKIVQSSDLRPLWQILPERLQKRARGQLRRGKTITPARLRAQLEELGLSVSAFDAEVTRQLDAANTRNRKNDERISRQGLLNRPFAAKRLDGRAAFARPLLKRAAEEVMAGKHPKEEGGCLFVTEEMRQAQLSREIAEQTNNHLVRHRLLILERLVGDIIKEYAGGDKARVAGITVEVNRDLREMSGMTAKQKAQDLGLRIANHHHVVKKLEEDESLMRVLRKQGTRITAGLIRKARVADDLGWACPYTGQRFEPVDLVTKRVDKDHIVPRASRASDSLESLVMTFSAINKWKGKRTAWQFVEQEQGKPVPDLPNLSITSLSRYKQLVESIETFKGHDDDKRRKKRRKDLMLLPVYEEKEFTPRDLTTTSQLVRLGAMALRKAFLGCKRQPVVVSLPGSVTGAVRKAWKVLGCLSLAAPGVLDENGEVKKKQEIREVTHLHHALDACVLALASHFIPNNGRIWELIVKGRWTPAEERELKTLGIFSWDSEGRFQVRDLDKTLKEQIRQRLGERRVVQHIPARMEGLRVEQNTWRVVSVKDGEATLRQRVRAADGSRPGKTTAEKVTKLLGLQPVSGRGKLLVNRGTLVIPDNFGVALVEPEPVIIPFHKVWPRLSELRAANGGRMPMVLRNGQLIRVPGGKSFKGVWRVFATKNNASGMALDIGSPDVVRLKNKTEGHKINVRLATLIRDGMEVLRTPLTGFAACPAPSSP

SEQ ID NO: 7309 - protein, 1078 aa, unidentified
  REGION 1..1078: note = Description of Unknown:uncultivated organism sequence
MSIKGKITRGTDANLHVSFDVGHSSIGWAVLEKTGEQVSDIKINGCGSVVFRADDCLASSRRAYRRQRRHIRSTRQRIARMKILLNHLGVLTEKELDKPGCAWPWKLAAQILQGGKLLTWPELWDVLRWYAHNRGYDGNRRWSAAEADAQSEDTEKEANANSLLDTYKIKYGREGSMAEVFCDIQEINPLGKKKSSNLSGDKRPKGQNAAFPRKIVEREVRQILQKHFGKLKKADANLEKVLFTDWQAIPCPDLKLPKRYEGGLLFGQLVPRFDNRIISICPISGQKVPSRNCPDFLNFRWAMQLANIRIACAGEKDLRPLTAAERKIIDQVVREKGGVTPFQLKLIVREKTKCVRDDLEQMLMLPDFEKALLLDPVQKMVSLDDFQPLWKLLPDRLQKRLRGKWRRGKVFLLAQIRAQLELLGDTSAFDTELQRQLDAHNIKAKKKEKQITREDLLQKHFPSKPLKLDGRAPFARHLLKQAYEEVMAGKDPNGKDGCLFRSEEIRQKELNREIADQTNNHLVRHRLLILERVLKDIIKEYADGKKERIGKITIEVNRDLREMSGKTNYEKQTDLNNRVKNHHAVAEKLEKAFAEESNGKSIRITAGLIRKARIAEDLGWKCPYTGQSYEPKHLITRFVDKDHIVPRSERASDSLDSLAITFSAVNKMKGKRTAWQFVSEDQGKPVSDLPNLSIMSLTRYKQLVEGLETRGSHEDDRRRKKRRKELLLLPKYEEKEFTQRDLTQTSQLVRLGAQVLKKNLPHLTTGDVTSLPGSVTGTVRKSWDVLGCLSAANSQVLDANKKVKTKTEIRDITHLHHALDACVLGLSSHFIPNNGRVWELIIKRNPNDLEKRQLEALGVFGFNAEKRFEMRDLDNKLKEQIRQRLAEKRVVQHIPARMDGLRVEQNTWRVVAVKDDEVILRQRVRQPDGTRPEKISEEKPAKLLGLNPTNENGKLAKNKGVLIIPDNFGVALDPQPTVIPFHKVWTRLQELKKANGGKMPRVLRNGQLIRVKDGTYKGVWRVFSAKNNATGMALDIGSPDIVRLKNKTEGHKINVLLSSLIKGGLDPLHTPFTGVNPK

SEQ ID NO: 7310 - protein, 1091 aa, unidentified
  REGION 1..1091: note = Description of Unknown:uncultivated organism sequence
MKDKQKITEKITSPPAHSDLELAFDVGHSSIGWAVLQTDGKMEISGCGAVIFRADDCLASTRRGYRRQRRHIRSTRQRVARMKVLLKHLGVLSGEQVDKPGCAWPWQLAAKVLRGGGLLAWSELWDVLRWYAHNRGYDGNRRWSAAEAEAAAEDTEKEENAKTLMGKHGVNSMAETFCAELQINPLGGKRASAIRFKGLNAAFPRAVVEGEVRRILRAHFGKLRGVDAALERALLGKDSQDKTAWQSIPCPQLKVPKRYEGALLFGQLVPRFDNRIISKCPVSGQKVPSRNCPEFLNFRWGMQLANVRVTRFGEKELSALTATERKQVDAVMRERGGMGVEEFKKQVRQIAGAIRDNLDTMLLHPDAKEALLLDPVQKLVESSEVKPFWRLLPERLQKRARGQWRRGKTITLAKLRAELEELGLSSASFDAEVTKQLDAANTRGRKKDKQTSREEMLSRPWSVKRLEQRAAYARPLLKRAFEEVMAGKHPREEGGCLFVTEAMRQAQMAREIAEQTNNHLVRHRLLILERLVGDIIKEYAGGDKARIAKITIEVNRDLREMSGMTAKQKAQDLGLRIANHHQVVKKLEEDDSLMKVLRRQKTRISAGLIRKARVAEDLGWVCPYTGQQFEPVDLVTRRVDKDHIVPRADRASDSLDSLVVTFSAINKWKGKRTAWQFVEQEQGKPVPDLPNLSIMSLSRYKQLVESLETFKGHDDDKRRKKRRKEWMLLPSYEEKEFTPRDLTQTSQLVRLGAMALRKAFVSCKQQPVVISLPGSVTGAVRKAWKVLGCLSLAAPQVLDENREVKTKQEIRDITHLHHALDACVLGLAAHFIPNNGRVWELIVKRQWTPAEERELRALGIFDKDAEGRFQMRDLDSRLKEQIRQQLAERRVVQHIPARMDGLPVDQNMWRLRGWGSEGKAILEKHSRDASGKRQKDNPKPGADNRDRLIGWQPEKGDGKLQRLKAVLITNENFGVALTKPQPVIVPFHKVWPRLSELKAANGGRMPTILRKGQLIRVPCGKNFKGVWRVFSAKNNASGMALDIGSPDVVRLKNKTEGHRINVRLATLIKDGMEVLKTPLTGVAACPAMSSA

SEQ ID NO: 7311 - protein, 1081 aa, unidentified
  REGION 1..1081: note = Description of Unknown:uncultivated organism sequence
MNGKGKVLAAKPNFGIAFDVGHSSIGWAVLQTEGRAEIAGCGAVTFRADDCLASARRGYRRQRRHIRSTRQRIARMKVLLKHLGALKPEQLDQPGCAWPWQLAARVLCGGKLLTWPELWDVLRWYAHNRGYDGNRRWSAADAEAIADDTEKEENAKTLMGKHRVGSMAETFCMELGVDPLGQKRASTVRFKGLNAAFPRAIVEGEVRRILQAHSGKLPKVDAALERALLGRDNRDRTAWQSIPCPALRLPKRYEGALLFGQLVPRFDNRIISKCPVSGEKVPSRNCAEFLNFRWAMQLANVRVARFGEKELTPLTAPERRQLDAAMRKQGGMGAEEFKKHVRQAAGAIRDNLDTMLLHPDAKEALLLDPVQKIVQSSDLRPLWQILPERLQKRARGQLRRGKTITPARLRAQLEELGLSVSAFDAEVTRQLDAANTRNRKNDERISRQGLLNRPFAAKRLDGRAAFARPLLKRAAEEVMAGKHPKEEGGCLFVTEEMRQAQLSREIAEQTNNHLVRHRLLILERLVGDIIKEYAGGDKARVAGITVEVNRDLREMSGMTAKQKAQDLGLRIANHHHVVKKLEEDESLMRVLRKQGTRITAGLIRKARVADDLGWACPYTGQRFEPVDLVTKRVDKDHIVPRASRASDSLESLVMTFSAINKWKGKRTAWQFVEQEQGKPVPDLPNLSITSLSRYKQLVESIETFKGHDDDKRRKKRRKDLMLLPVYEEKEFTPRDLTTTSQLVRLGAMALRKAFLGCKRQPVVVSLPGSVTGAVRKAWKVLGCLSLAAPGVLDENGEVKTKQEIREVTHLHHALDACVLALASHFIPNNGRIWELIVKGRWTPAEERELKTLGIFSWDSEGRFQVRDLDKTLKEQIRQRLGERRVVQHIPARMEGLRVEQNTWRVVSVKDGEATLRQRVRAADGSRPGKTTAEKVTKLLGLQPVSGRGKLLVNRGTLVIPDNFGVALVEPEPVIIPFHKVWPRLSELRAANGGRMPMVLRNGQLIRVPGGKSFKGVWRVFATKNNASGMALDIGSPDVVRLKNKTEGHKINVRLATLIRDGMEVLRTPLTGFAACPAPSSP

SEQ ID NO: 7312 - protein, 1201 aa, unidentified
  REGION 1..1201: note = Description of Unknown:uncultivated organism sequence
MNATKKIESTKADLDLAFDVGHSSIGWAVLQSVGQATAQATNPFDINILGCGVVTFGADDCLASKRRDFRRQRRHARSTRQRIARMEKLLAHFKALTPEQIASKHKQAGGHPAPWLLAARILASNGEFLLGWPELWDVLRWYAHNRGYDGNARWANVSDDALAPAEQEEKRSDLEKEQNAIKLMNDYGKQTMAETVFADLFAEFGIAEPTKVKALPYLQKRFKGNQCAFPRKTVEAEVLRILQVHNFCDAKLIHLLVARKLSDEDRAFLTSIDIHLPKRFQGGLLFGQLVPRFENRIIAQCPITGAKVPGRHCHEFLEFRWAMTLANIRIGFGDEKYEEDANLRSLTAAERHKVDARVRRLGFLKIEPDKAGKDGVVRPGKNELRAIVIEETKCERHNLDTLLLHPDAKDGLKLLPIKGDTTAFRVAWSCFDDPQHDANGRYVDDQLRRRYTTQLLRGTKERPRKLTIQRILEDLERIKRSEIAARLRQTATREAQGKKAKPDSGKLYALFNAEFYCDKLNGRARYSRDMLNSAIQQVFDKIKPAHPLEKGGCLEQTEKIRREALEKPLDRQTNNHLVRHRLLILKRLHEHIVQDFAMGDKARISRVTVEVARDLQTMSGMNNKEKAKELTGKLKHHHKIAAHLAEELKDERDENGRPFVISPGLIRKARVADDLKWQCPYTGRIFGPPSLVHRLFDKDHVIPRSKRLSDALEALVITTREVNAEKKARTALQFVKEMNQSENLAKRDQLGIRTEAQFREFVDSLWPKSDPFRRARAGGARATDDEARCWRRKQLLLTETWEENEFTPADLTKTRQIVKLAAQQLEATFKDSPEMQKPAIISIPGAVTAAFRDKSWKLLPLLGNANPKVNNLHQQKIESEKCGRDFNFKKAVREVTHLHHALDAVSLGMITALLVPAGDAGHAGLNGDLARFIHKTKLTAEERSQFEVIRHKLGLPKFYRWAPSGYDSEKKQQSTASEGFTLRISELPDSVKRQISERLIEKRVVQHIPADMSGLKVEENTRGIVRIENGRVHLRQQKRDDKTGKLIHNPSDEVQNKLVGLPSDQASSKLKAVKGVRVINDNFGVAYLNQSDDPGSPFVIIPHHKVWHRLKELKIRNHGKRPIILRKGDIIEFKKGDQLLRYRIFGAGQRARGLYLDAAFLDELDRSVELYPATLLRGSFRLVQTSLTGAERKSCPTTSSA

SEQ ID NO: 7313 - protein, 1079 aa, unidentified
  REGION 1..1079: note = Description of Unknown:uncultivated organism sequence
MNIKRKISNGADANLQISFDVGHSSIGWAVLEKTGAQAADISILGCGSVVFRADDCLASSRRAYRRQRRHIRSTRQRIARMKILLTHLGVLTEAELARPGCAWPWKLAAQILKGGRLLTWPELWDVLRWYAHNRGYDGNRRWSAAEVDAQNKDSEKEANAHGLMGKYGTKSMAETFCALCDIDPLGAKKSANIPGDKRPKGQNAAFPREIVESEVRQILQKHLGQLKNLDISLIRALLGNDHHDKLAWQAITCPDLKLPRRYAGGLLFGQLVPRFDNRIISTCPISGQKVPSRNCPEFLNFRWAMQLANIRLGKKLDRELRPLSGPERVALNQQMRVRGYLTPKELTDAVRHLTNCERDNLDTMFMHPDAKEALLVDPVQKLISSDELQPFWNKLPEQLQKRLRGQWRRGKVFSLRQIRQQLELIGNTSTFDKELQYQLDTQNTKAKKKDQPVTPEKLLQKHFPSRPLKLAGRGAYARHLLKQAYEDVLAGQPHPKEQGGCLFLTEEIRDAQLNLATAKQTNNHLVRHRLSILERLLHDIIKEYAAEKRERIGKITIEVNRDLREMSGKTAKEKAKDLGSRVANHHHVAEKLEKAFAAENLKRPITAGLIRKARIAEDLGWKCPYTGHPYEPKHLVTRYVDKDHIVPRSERASDSLASLAITFSAINKLKGKRTAWQFVSEEQGKTVPDLPNLSILSLTRYRQLVESLESYQGHDDDKHRKKKRKELMLLPKYEEKEFTPGDLTQTSQLVRLGAQILRKNLPHLTTGDVISLPGAVTSTVRKAWKVLGCLSLANPQVLDENNSVKSKTEVRDITHLHHALDACVLGLSSHFIPNNGRVWELIVKRNPNDLEKQQLAVLGVFGFNGDSRFEMHDLADNLKEQIRQRLAEKRVVQHIPARMDGLRVEQNTWRVITQKDGEVILKQRIRQPDGTRPEKISAEKSSKLLGLNPANGNGKLAKNKGVLVIPDNFGVALDPQPTVIPFHKVWTRLQDLKKANGGKMPRVIRNGQLIRVTEGKYKGVWRVFSAKNNAAGMALDIGAPDVVRLKNKTESHKINVLLSSLTKSGLEPFHASFTGVSSK

SEQ ID NO: 7314 - protein, 1207 aa, unidentified
  REGION 1..1207: note = Description of Unknown:uncultivated organism sequence
MSAKQKMQSSTSAGDSADLQIAFDVGHSSIGWAVLQTDARAVSQAHMSSVNILGCGVVTFGADDCLASKRRDYRRQRRHTRSTRNRIERMEKLLVHLKVLSAEELKQKHQQAGGHAAPWLLAACVLASNGDAKHLLDWPKLWDVLRWYAHNRGYDGNSRWANVSEDVLTATEQDEKKSDTEKEQNAIKLMNDYGKHTMAETVFADLFTEFKITDPTKVKALPFLQKRFKENQCAFPRKMVEAEVLRILQAHKSCDAKSIHLLLTKKLADEDRAFLENIGIRLPKRYEGGLLFGQLVPRFENRIIAKCPITGGKVPGKHCHEFLGFRWAMTLANIRIGFGDEKYEDDAKLRPLTTDELHKVDARVRRLGFLKLEPDKPGKDGLVRPGKNELRTIVITETKCDRHNLDNLLLHPDSKEGLKLLPAKGDTTAFRVAWSCFGEPRHDAKGCYHDDTLRHRFTTQLLRGTKENPKKLTIQKILDELNRLKKTDVAERLLQAAVQEAQGKKIKLDRDKLNALLNAEFYCDKIKGRARFSREMLSQAVQQIFQKPKPIHPLEKGGCLEQTEKIKRAALEKPLDQQTNNHLVRHRLLILKRLHDHIIHDFAAADKSRISRITVEVARDLQTMSGMTNKEKAKELTGKLKHHHETAADLAEKLMDERDEKGHPFAISPGLIRKARIADDLKWECPYTGRTFEPASLVHRSYDKDHVIPRSKRLSDALEALVITSREVNGEKKTRTALQFVKEMSQPENSAKRDRLGIRTEAQFRAFVDSLWPKSDPFKRARAGGNRATDDEARCWRRKQLLLTETWEEKEFTPADLTKTRYITKLAAQHLEATFKDLPEPQHPAIISITGAVTAAFRDKSWKLLPLLGSANPQINKLHQQKIEAEKTGRDFNFKKAVREVTHLHHALDAVSLGLITALLVPPGNAGRAGLNGDLARLIHKGKLTAEERNQFEALRHKLGLPKFYRWSVSRCDDKDKRNPAAGQGGTLCIDQLSESIKQQICERLTEKRIVQHIPADMSGLKVEENTRGIVKAESGRIYLRQQKRDEKTGKLTTNPTDEIPNKLIGIPPNGVTSKLKAVKGARVINDNFGVAFLHRNAESADRFVVIPHHKVWHRIEELRTRNQGKRPIILRKGDIIEFKKDDQFVRYRIFGAGQRARGLYFDAALLDELDRSVELHPTTLIRGNFRLVETSLTGVERKSCSITSSA

SEQ ID NO: 7315 - protein, 1163 aa, unidentified
  REGION 1..1163: note = Description of Unknown:uncultivated organism sequence
MQKYQNHFMSATKKVADLSLAFDVGHSSIGWAVLQTLRSQPLSLLGCGSVIFPSDDCLASQRRAFRRQRRHIRATRLRIARMARLFAHLEVLPKAQLEAPGCAWPWLLAARVLRGGKKLSWAELWDVLRWYAHNRGYDGNRGWSRNDVASNEDTDKEKRASELLTEFEMKYGWAGTMAEVFCDVLKVDPLGEAKSSTQRVRNLGAAFPREGVEREVERIMRAHVDVLERVDDRLINALMRDHKALIGPDLHLPARYGQRLSDGSLSPGGLLFGQLVPRFDNRIIARCPITFERVYQREKAESGDEQQAKHEAEKLAKVPSVDCVEFHRFRWAMELAKIKVATSDPRAPRNLTAVERQSVNVEMEKRGYLSASELKKAVRAQTSGAPDNLEQILTHPDAERALVLDPVRRYIHSDQLVSALWQGLPERLQKRLCGQWRRGHATTVAELLNACGEFRTAAEAVCEKYLDSQNTRNRKKDKPLTREDLIRTPLHVKPPNGRAPHTRQIMREVVDFVFSTDRHPAEEGGPLYRSEAIRQAQLQRALDEQTNNHLVRHRLKLLERLHVDLLKTYADGAWTRIARITIEVNRDVRELSGMTAQEQAKLQGQQLAHFKGVAKKLAEAYEGLGVHVGPGLIRKGRIAEDLGWTCPYTGKGYDALDLLHRRVDKDHIIPRSDRASDSLDSLVITFSEINKMKGKRTAARFVEEFQRQPVQGLPQVMIKPLSTYLKDVEALETFKGHDDDQRRKKNRKRLLLLRDYVEKEFTPGDLTQTSQLVRLGAQVLQKHYIGAEKQPIITSLPGSVTGAVRKSWNLIGCLAPANRQVLNPDDLDEDGRPKVRTKTEIRGITHLHHALDACVLAFASHFFPRDGGGWELLVKRRLNAEEERRARTLFGSHIEITKDGQLRLADLAKLAPYLQAQVGNRLKERRVVQHLPADLSGLRCKETVWRVFDPADPHHNSRRLARWLAQKKVSIPSPDAKTALIICRKRRAADVAGEESAGGKVFRETKTWRWIYDIKDKTALLGLAPEGDAAAAKLKRIKAVKVLGDNFGLALDPEPTLIRPHKVWHQLAALRQRNGGKTPRLLRIGTIIRVTEKGPRSDYRGTWMVRGMSFKQRDGLVLEIAPPDYVQSRRVPGVFESASVTTLLKCGLEVLKAPLCGVATILA

SEQ ID NO: 7316 - protein, 1514 aa, unidentified
  REGION 1..1514: note = Description of Unknown:uncultivated organism sequence
MNAIKKILPGTNPDLQLAFDVGHSSIGWAVLQNNNTSSANSLAMPDIRASGVLLFPADDCMASVRRQLRGQRRHTRATRKRIEQIAKLLLKLLHNKSEPNAAKLVEHLEHYLNPNPKNRAMLQGKGHPAPWLLAARVLRGGNLLDWPQLWDVLRWYAHNRGYDDNVPWARESESRSLSDQAQQAQEQDRKRQAQAIALMKRYGTEGTEPSMAETVFCYLFDEADSGHCDLDPRQVDQLPFFQRYFKEEECIFPREIVKAEVRQILNRHRAMVESAGISADTFIQALLENWRVLPKEFLGNPKAKDRIWLPKRYGTYTKRQFADGRVIEERTHAGLLFGQLIPRFENRIVSTCPFTFARLYGQFLNQGINEEQWKLLPKSWKSRITPNQSLPEETARHLARIAAKVPTKACQEFLQYRWAMLLADLTVRSKGNGVSRKLSATERKYLDNEMQKRGTLSIDELHELISTAALGCEAANLDDIFQETPERAKELFVDQAKNFAANDKYARELFPLLPERLHRRILNELRRGHSFKVSSLLELLKKFGYAKETSDFEAKVQWLQDAENLNAGKGRHSKSKKSAGKAKHRSIPILERILKLKPLSGRARYHRDILKKAAQEVLDGFDPNKKALVPQNPDDKSEQKAKDGCLVETPEMVSLALGHTSSAENAEAAFQNWLAKWRKKKNRKGKLANEALFQKRGEAYAREVYEARTSDQWLAAQTNNHLLRQRLLLMRRLTDDIIAEFADGKAERITGVVIEVARDLLAFSGMQKKDIGSDTKGALKSIKAQHYRVEEKMFKELRSEGKEYLINANLLWKGKVADDLDWKCPYTGSRIYPIDIALGTMDVDHIIPRSKRLTNAMEACVITYKEINQKKKNMTAREFVTRFQGKRIGGLNKEIRHINDYLNFVKTLKLCRPPKAKGQANGEPAANDDTQDDNTGALDLNPKYLPGTDRLHPDYVRRRKRQRLLKIKNASDEDLGFAKRDLTVTSHLNRLAQSALLRALPHLRPENFVSLPGVVTGSVRDMGGWQLLGVLGRPNVCGEKAMRKVKKINYETKEVERDPKTGEVLWKPIPRKKNEIRKLTHLHHAIDACTIGILAHVLPKDGKLWEYIAVGDLSEIQAADFRKRSDEFKWRGHPFSSLFTLVPISENEREEESEKPRTQRVKMVWNKQNKALLDKIKDSIGNAMEAKRVRLHIPAEQGGMPTNQTVYRILASLDTPGYIPQLARAVVSAKEQQLKRLEEAIANEKNKARLKKLTVERDALAKLLIKLKDFSQNVWLVNRTRAESENGKQILKRLKEYEDWRRRSNEAPIVEPADEADDEDLDVETEDEDKKNKKSNRKKREPNLLRPFNREKHKLLYTYDVVSRERVIGLPPDNKAEQARLLPLKAGKELGANFAAVILPPIEVGGEKQWRDGKEIIVLPFFQVHKSLGLLKAENKGKEIQLLRNGTLIQVPKGERQGWWRIISVKDTEAYGIAVDLANPDGVEKAKGNAPVSVLLADGMKIISSTLTGHDIRK

SEQ ID NO: 7317 - protein, 1220 aa, unidentified
  REGION 1..1220: note = Description of Unknown:uncultivated organism sequence
MAISIKKNLMGAKTIPDLELSFDVGHSSIGWAVLQSSAGVSPAANTPRVNILGCGVVMFGADDCLASERRKKRSQRRHLRATRKRIVWIERLLVHLGVLSTEAFEAVHKQAGGDSFAWQRAAEILVNVRNQKPLPELGWPELWNILRWYAHNRGYFSPPWANREEDSVADDNDVPDTEKVERANAIMREFKTVTMAETIAAYTVRYEQEVAEWQQKKRTEKPPHFKGLKAAFLRESVVWPEVRDLLTALKGKLPKLDDALIRALLGNDPDPMKDRDAWRTIPCAAIKLSARYQGGLLFGQVIPRFDNRIIGVCPIQFARRQAELIAAGFSADNAKDKAAKESKLPSKATPEFLRFRWAMQLANIFGALVGGRETRALSADERKQITERAERQGAFAKGEFKKAVREIAGWPEKLSRDNLDNLLMHPDAEKALVLDPAQREVHNSKLAAALTALPECYRKRLLGKLRRGHSVSHKQIHGWLAGADADAFDAEIQRVIEAANTKHSKKQTPPTREELLAEKLVAEFPKGRAPYARPVLRQAYEEVMKGWDPRAEKRDQRPRGCLCQTDELKEAQLQRRLEEQTNNHLIRHRLLILGGEQPKPDATPEQERRRFKGLLHDIIQEFSNGDKSRIAGMTIEVNSELRDLSGKTRKAQEQDLGLRFGDFKRVAAKVEEACKRRGIRVTAGIIRKARVAEDLGWRCPYTGKDFCIDTLLDGVMDKDHIIPYADRESDSLDSLVMTWNEVNKWKDKRTAMQFIRDEGGKRVPGRPELEIMALAVFQKHVAGLDTRKGHDDDRNRKKRRIRRLLTEHYEEKEFTPRDLTVTSHLVRLGAQVLQRAFPKDQRPPVVSLPGSVTGEVRKAWKLTGCLEAANPAVMEEVEERDEATGELKRVRRAKKKNDIRGITHLHHALDACVLALATNYFPRNGAVWSTMVKAGIDREADDDRRLWLAMTKRRPTPAEAALLKNTGLYKADAQGRMHLDKLPEPLKQQLCQRLAEKRVVQHIPADMSGMHVEENTRSAIANGNGKYDLNPPHDKGALPTKKLVGLQPTNGNGKLKPQRGVRVITDNFGVAILDNNAEHKFQIIPWFKVWPRLYKGIGDEKSLVEQNAGKMPRILRNGMLIRIGKFRILKPTRILENSIWSVDSIGDFDGVIKVDLKQCDTVNTRFDGIDPTDPTGKKKKKFTSPGCKLSTDLERVYEGGLEILKTPLTGIASCPITSSA

SEQ ID NO: 7318 - protein, 1206 aa, unidentified
  REGION 1..1206: note = Description of Unknown:uncultivated organism sequence
MGAKIFQDLELAFDVGHSSIGWAVLQSRTDVSPAANAPRVNILGCGVVTFGADDCLASKRRTYRSQRRHLRATRKRIAWMEKLLAQLGVLSTEAFEAVHKQAGGDSFAWQRAAEILANARSQKPLPDLGWPELWNILRWYAHNRGYFSPPWANREEDSIADDNDVPDTEKVERANAIMREFKTVTMAETISAYTVRYEQEVAEWQQKKRAEKSPHFKGLKAAFLRESVVWPEVRDLLTALKGKLPKLDDALIRTFLGNDPDPMKDREAWRTIPCPAIKLSGRYHGGLLFGQVIPRFDNRIIGVCPIQFARRQAELIAAGFSADDAKDKAAKESKLPSKATPEFLRFRWAMQLANIFGERAGERETRALSANERKQITERAERQGAFAKGEFKKAVREIAGWPDKLSRDNLDNLLMHPDAEKALVLDPAQREVHNSKLAAALTALPERFRKRLLGKLRRGQSVSYKQIHGWLAGADADAFDAEIQRVIEAANTKHSKKQTPLTRDELLAEKLAAEFPKGRAPYARPVLRQAYEEVMKGWDPRAEKKDQQPRGCLCQTDELKEAQLQRRLEEQTNNHLIRHRLLILGGEQPKPNAKPEHERRRFKGLLHDLIQEFANGDKSRIAGMTIEVNSELRDLSGKTRKAQEQDLGLRFGDFKRVSAKVEEACKRRGIRVTAGIIRKARVAEDLGWRCPYTGKDFCIDTLLDGVMDKDHIIPYADRESDSLDSLVITWNEVNKWKDKRTAMQFIRDEGGKRVPGRPELEIMALAVFQKHVAGLDTRKGHDDDRARKKRRIRRLLTEHYEEKEFTPRDLTVTSHLVRLGAQVLQRNFPKDQRPPVVSLPGSVTGEVRKAWKLTGCLEAANPAVMEEVEERDEATGELKKVRRAKKKNDIRGITHLHHALDACVLALSAHYFPHHGTVWSTMVKAGIDREADDDRRLWLAMTKRRPTPAEAALLKTTGLYKADAQGRMHLDELPEQLKQQLRQRLVEKRVVQHIPADMSGMRVQENTRGITAIKDGRVFLRQQSRDAKTGKLSINPTEESANKVIGLKAGKLTPQKGVRVITDNFGVAILDHAPEGEDKFVIVPWHKIWVRIYKGFKDEAGKTIEKSLVERNGGKQPRILRIGTLIRVSNPKNKAYKGIWMVRGVQLNQRAGYLVDISEPDVIEYRVPKRKDCKQNVGLKALVQGGLEILKTPLTGVVSPPLKLAE

SEQ ID NO: 7319 - protein, 985 aa, unidentified
  REGION 1..985: note = Description of Unknown:uncultivated organism sequence
MQKEQLDLPGCAWPWQLAARVLRGGVLLTWPELWDVLRWYAHNRGYDGNRRWSAAEAEAQKEDSEKEANARTLMGKHGVSSMAETFCKELGIEPSGKKKSSMRRFKGLNAAFPREVVEREVRKILEAHFDKLKAVDKNLEDVLFSDWRAIPCPGLKLPKRYEAGLLFGQLVPRFDNRIISKCPISGQKVPSRNCPEFLNFRWAMQLANIRVLRFGEKELAPLTVPERKQLDTLMRQQGGMGVEEFKKQVRQTTSAIRDNLDTMLMHPDAKDALLLDPVQKLIQSTELKSFWPLLPSPVQKRTRGQWRRGKNLTLAKWREQLGTDTAAFDDQVTRQLDAENIKGRKKDKQISRDEFLNRPFSVRKLDQRAAFARHLLQKAFEEVMAGRHPKEEGGCLFVTAGMRNEQLQREIAQQTNNHLVRHRLLILERLLADIVKEYAAGDKTRIARMTIEVNRDLREMSGMTAKQKAQDLGLRIANHHHVVELLEKNDSLMKALQKQKSRISASLIRKARVADDLGWMCPYTSQRFEPVDLITKRVDKDHIVPRSDRVSDSLDSLVITFSAINKWKGKRTAWQFVEQEQGKPVPDLPNLSILSLTRYRQLVNGLETFKGHDDDKRRKKRRKDLLLLPAYEEKEFTPGDLTTTSQLVRLGALSLRKAFIGCKDQPVIVSLPGSVTGTVRKAWKLLGCLSITAPLVLDENGELKTKNDIRDITHLHHALDACVLGLASHFIPNNGRVWELILKRKWTPAEENELKALGIFAKDSEGRFQMRDLDKALKDQICQRLAEKRVVQHVPARLEGLRVEQNTWRVISVKDGEATIQQRIRQSDGSRPVKDAVEKTSKLLGLEPVTGNGKLKAEKGALIIPENFGVALDPQPTIIPFHKVWTRMQELKAANFGKKPRVLRNGQLIRVPNGKNFKGIWKVFSAKNNASGMAVDIGFPDVVRLKNKTEGHKINVRLATLIKDGLEILKTPLTGIAAYPIPSSA

SEQ ID NO: 7320 - protein, 1113 aa, unidentified
  REGION 1..1113: note = Description of Unknown:uncultivated organism sequence
MNSHPISPDLQLAFDVGHSSIGWAVLQKSDGQTPGINILGCGSVVFRANDCLVSSRRAYRRQRRHIRSTRQRIARMKTLLQQRGVLTAAELEKPGCAWPWKLSARVLQGGKLLTWRELWDVLRWYAHNRGYDGNRRWSAADEAAQSEDSEKEGNARTLMGKYAARSMAETFCAMCGINPLGKKRSANVPGAQRPKGQNAAFPREIVEGEVRKVLRAHFGNLNGVDANLETALFSDWRAIPAPGLQLPNRYQGGLLFGQLVPRFENRIISNCPVTWQKEFARATEALTNEDPNFIKLHRVDFAKHDGSWWASHIADKLAKVPSRNCPEFLNFRWAMQLANIRVGKKLDRELRVLSTGERKRLDQQMRLCGYLTPGQLKDAVRRFTDCERDNLDTMFMHPDAKEALLVDPVQKLITSEELRPFWTLFPERLQKRLRGQWRRGKSFSLAQIRSQFEPLGDVSQLDAELQKQLDAQNTKAKRKDKQMTRDDLLQRCFPPRPLKLDGRAAFARPLLKQAYEDVVAGKPHPKEAGGCLFISEEIRQTQLNRELADQTNNHLVRHRLLILERLLADIIKERDFADGRKERIGKITIEVNRDLREMSGMTAEEKAMDMGSRVANHHAVADKLEKAFAEESNGKSIPITAGLIRKARIAEDLGWRCPYTGIQYEPKDLITRRVDKDHIVPRSDRASDSLDSLAITFSAINKWKARRTAWQFVSEEQGKPVPDLPNLSIMSLSRYKQSIEGLEAFKGHDDDKRRKKRRKELLLLPRYEEKEFMPRDLTQTSQLVRLGAQVLRKNLPHLTTGDITSLPGSITGTVRKSWRVLCCLATANRQVLDEHGEAKNKTDIRDITHLHHALDACVLGLASHFIPNDGRIWELIVKRSPNDSEKRQLEALGVFGFNADKRFEMLDLDKKLKEQIRQRLAEKRVIQHIPARMDGLRVEQNTWRVVAVKDGEVILKQRVRQPDGTRPEKTAEEKPAKLLGLAPVNGQGKLATNKGALVIPENYGVALDPQPAIIPFHKVWPRLQELKKANGGKMPRILRNGQLIRVKEGNFKGLWRVFSAKNNATGMALDIGSPDVVRLKNKTEGHKINVRLASLLKGGLEPIRSPLSGISSK

SEQ ID NO: 7321 - protein, 1081 aa, unidentified
  REGION 1..1081: note = Description of Unknown:uncultivated organism sequence
MSIKGKFLNGAGANLRLSFDVGHSSIGWAVLEKTGTQPSDINILGCGSVVFRADDCLASTRRAYRRQRRHIRSTRQRIARMKILLRHLAVLTEADLDKPGCAWPWKLAAQVLQGGKLLTWPELWDVLRWYAHNRGYDGNRRWSATESEAQNEDSEKEANARTLMGKFATKSMAETFCAMSGINPLGKKKSTHLPGDERPKGRNAAFPREVVEREVRQILQKHFGQLTGVDTNLERTLIGTNNRDEKAWEAIPCPDLKLPKRYQGGLLFGQLVPRFDNRIISICPISGQKVPSRNCPEFMNFRWAMQLANIKIGRASDRELQPLKAEHRLALDQQMRVRGYLTPGQLKDAVRELTGCERDNLGTMFMHPDAKEALLVDPVQKLVSSDELQPFWKLLPERLQKRLRGQWRRNKSFTLAQIRQQLEPLGEAGLFDLELQRQLDAQNTKSKKKDKPATRDELLQKRFPSRPLKLDGRAAYARHLLKQAYAEVLAGRPHPKEGGGCLFLSEEIRQKQLNSEIAEQTNNHLVRHRLVILERVLNDIVKEYAAGKKERIAKITIEVNRELREMSGLTAKEKAQDLGLRIANHHAVAEKLEMAFAEESNGQSISITAGLIRKARIADDLGWKCPYTGIQYEPKDLVTRRVDKDHVVPRSERASDSLDSLVITFAAINKWKGKRTAWQFVSEEQGKTVPDLPNLSIMSLTRYKQVVEGLETFKGHVDDKRRKKKRKELLLLPKYEEKEFTPRDLTQTSQLVRLGAQVLRKHLPHLTTGDVTSLPGSVTGTVRKAWHVLGCLATANPQVLDENSKVKSKTEIRDITHLHHALDACVLGLASHFIPNHGQVWELILKRSLNDLERRQLAALGVFGFNAENRFEMFDLADRLKEQICQRLAEKRVVQHIPARMDGLRVEQNTWRVVAQKDGEVILKQRMRQPDGTRPEKVAEEKPSKLLGLKPVGGSGKLAKIKGALVIPDNFGVALDPQPTVIPFHKVWIRLQELKNANGGKMPRVLRNGQLIRVKEGKFKGVWRVFSAKNNATGMALDIGSPDVVRLKNKTEGHKINVRLSSLIKCGLEPVRASFTGVASK

SEQ ID NO: 7322 - protein, 1145 aa, unidentified
  REGION 1..1145: note = Description of Unknown:uncultivated organism sequence
MRGTPDLHLAFDVGHSSIGWAVLKAASQQVPELLGCGSVIFPADDCLAAQRRGFRRQRRHIRATRLRIARLRRLLAHLGVLTTEQLEAPGCAWPWLLAARVLCGGKTLSWPELWDVLRWYAHNRGYDGNKGWSRHEADSADDEDTEKEKRAGELLDDFRKRHGRRGTMAEVFCDVLKVDPLGPVKSSMERVRGLGAAFPREGVEAEVERVLRAHLGGLQQVDERLIEALMRDNTALPGPDLRLPKRYGQRVNGVRTPGGLLFGQLVPRFENRIIATCPIMYQRVYESEFAATGDAERARHEAEKLAKVPGADCNEFRRFRWAMQVVNIQVATDDPRQPRRLSVAERGEIDKLMRERGALTVTELKKAVRAITGAKDNLDQMLVHPDAAKALVLDPAQELVSSGGFAVIWQYLDGPARAHTKTNLRRGKSVTLRALLAAAPAEAAFSKWFDGESLKKRKNPLVRDEVLDEPHRIRPESGRAPYTRQVMSEACEEVFQSGIHPADEGGVLFRSEAIRNAQLRRALDEQTNNHLVRHRLKLLERLHADLLKAYADDDKTRIARVTIEVNRDIKEFSGKTAQEQAKDLGQRLANFKSVVKKLEADFEGKNIHITPGLIRKARIAEDLGWACPYTGKAYDAFDLLHRRVDKDHVVPRSDRSSDSLDSLVITFAEVNKMKGRRTAALFVEECQSQPVPGLPNVAVKPLAVYLKYVAGLETFKGHDDDQRRKKRRKQLLALRDYVEKEFVPRDLTQTSQLVRLGAQALQKHYLGDAQAPVIISLPGSVTGAVRKSWKLAGCLGLANPQIFDEEGEPRTKADIRGITHLHHALDACVLAFASLFLPRDGGAWELLVKRRLSPDEQRRARACFGSHIEISKDGELRLPDLPSQYKEQIRACLAERRVVQHVPADPSGLECKETVWRVFDATDRHHSTRRLGRWLEQAKIAVPASDARTALIVCRKRKSTAETESTGGKVLRETKIWLWVFDIKDKSALLGLEPDGDPAQAKLKKLKAVKVLGDNFGLALDPQPTLIRPHKVWPQLQSLRSANGGKPVRVLRKGILVRVPKRGIRPKYEGVWMVRGVTLNQRAGFLVDMSPSDQIIYRRHPGCLENVSVATLLRCGLEVLRAPLSGVPPLPKQAEGYDVPGISDC

SEQ ID NO: 7323 - protein, 1086 aa, unidentified
  REGION 1..1086: note = Description of Unknown:uncultivated organism sequence
MIFMSTKKIQLAFDVGHSSIGWAVLKTGDVVDLLGCGAVIFRADDCLASARRGYRRQRRHIRSTRQRIARMKVLLAFLGVLSKAQLDQPGCAWPWQLAARVLRGGELLTWPELWDVLRWYAHNRGYDGNRRWSAAEKEADNEDTEKEENAKKLMNKCGVHTMAETFCAICGIDPLGKKRSTNLPGADRPKGQNAAFPRATVESEVRRVVQAHFGKLEKVDANLERALLGQSNQDKTAWQAIPCPDLKLPKRYEGALLFGQLVPRFDNRVISTCPISGAKVPSRNCPEFLNFRWAMQLANIRVSRLGEKELSALTVQERKQLDSLMRAQGGMGVEEFKKQVRQVSGAIRDNLETMFMHPDAKEALLLDPVTKLVESSEVKPYWALLPERLQKRTRGQWRRGKSITLAKLREQLSELCGDTASFDAAITRQLDKANTRGRKKDIPTTVAEFVNQPLSIRKLDQRAAFSRPMLKRAFEEVMAGKHPKEEGGCLFITEKMREAQLTREIAEQTNNHLVRHRLLILERLLADIVREYAAGDKTRVAKITIEVNRDLREMSGMTAKAKAQDLGLRIANHHQVVRKLEEDESLMKILHERRAKITAGLIRKARVADDLDWTCPYTGQRFQPVDLLTKRVDKDHIVPRADRATDSLDSLVITFSAINKWKGKRTAWQFMQEEQGKAVPDLPNLSIMTLSRYKGLVESLDTFKGHDDDKRRKKKRKELMLLPTYEEKEFTPGDLTATSQLVRLGAMALKKAFVGCARHPVVVSLPGSVTGAVRKAWRLLGCLSLANPQVLDEKGEVRNKDEIRDITHLHHALDACVLGFSSHFIPNDGRTWELITKRKWTPAEENELKALGVFDKDSEGRFQMRDLDNELKEQIRQRLAEKRVVQHVPARMDGLKVEQNIWRVVSVKDGEASLQQRIRQPDGSRPVKHGEEKVGKLLGLQPTGGTGKLNANKGVLIIPDNFGVGLDPHPTIIPFHKVWTRLKELKSSNGGKTPRVLRNGQIIQVPNGKNFKGIWKVFSAKNNASGMALDIGSPDVVRLKNKTEGHKINVRLATLMKDGLEIQKCGLTGVPACPTTSSALIPPTAP

SEQ ID NO: 7324 - protein, 1081 aa, unidentified
  REGION 1..1081: note = Description of Unknown:uncultivated organism sequence
MNGKGKVLAAKPNFGIAFDVGHSSIGWAVLQTEGRAEIAGCGAVTFRADDCLASARRGYRRQRRHIRSTRQRIARMKVLLKHLGALKPEQLDQPGCAWPWQLAARVLCGGKLLTWPELWDVLRWYAHNRGYDGNRRWSAADAEAIADDTEKEENAKTLMGKHRVGSMAETFCMELGVDPLGQKRASTVRFKGLNAAFPRAIVEGEVRRILQAHSGKLPKVDAALERALLGRDNRDRTAWQSIPCPALRLPKRYEGALLFGQLVPRFDNRIISKCPVSGEKVPSRNCAEFLNFRWAMQLANVRVARFGEKELTPLTAPERRQLDAAMRKQGGMGAEEFKKHVRQAAGAIRDNLDTMLLHPDAKEALLLDPVQKIVQSSDLRPLWQILPERLQKRARGQLRRGKTITPARLRAQLEELGLSVSAFDAEVTRQLDAANTRNRKNDERISRQGLLNRPFAAKRLDGRAAFARPLLKRAAEEVMAGKHPKEEGGCLFVTEEMRQAQLSREIAEQTNNHLVRHRLLILERLVGDIIKEYAGGDKARVAGITVEVNRDLREMSGMTAKQKAQDLGLRIANHHHVVKKLEEDESLMRVLRKQGTRITAGLIRKARVADDLGWACPYTGQRFEPVDLVTKRVDKDHIVPRASRASDSLESLVMTFSAINKWKGKRTAWQFVEQEQGKPVPDLPNLSITSLSRYKQLVESIETFKGHDDDKRRKKRRKDLMLLPVYEEKEFTPRDLTTTSQLVRLGAMALRKAFLGCKRQPVVVSLPGSVTGAVRKAWKVLGCLSLAAPGVLDENGEVKTKQEIREVTHLHHALDACVLALASHFIPNNGRIWELIVKGRWTPAEERELKTLGIFSWDSEGRFQVRDLDKTLKEQIRQRLGERRAVQHIPARMEGLRVEQNTWRVVSVKDGEATLRQRVRAADGSRPGKTTAEKVTKLLGLQPVSGRGKLLVNRGTLVIPDNFGVALVEPEPVIIPFHKVWPRLSELRAANGGRMPMVLRNGQLIRVPGGKSFKGVWRVFATKNNASGMALDIGSPDVVRLKNKTEGHKINVRLATLIRDGMEVLRTPLTGFAACPAPSSP

SEQ ID NO: 7325 - protein, 1172 aa, unidentified
  REGION 1..1172: note = Description of Unknown:uncultivated organism sequence
MNYKLKNHEFDLQLSFDVGHSSIGWAVLEAQNHQAPTMLGCGSVVFQADDCLASERRGFRRQRRHIRATRLRIARMRRLFEHLGVLTKDALESPGCAWPWLLAARVLRGGEKLSWSELWDVLRWYAHNRGYDGNKGWSKHDVVSAEDSDKEKRAGELLTGFQKKYGRAGTMAEVFCDVLKIDPLGPLKSSMLRVRNLGAAFPREGVEAEVEQILRAHIGVLAQLDDRLINTLMRDFTALPGPDFRLPARYGQRLSDGSLSPGGLLFGQLVPRFDNRIIASCPITFERVYQAVKTETGDEKQAKEEAEKQAKVPSVDCIEFYRFRWAMELAKIKIATSDPRAPRNLTVAERKAVNAEMEKHGYLTPGALKKFVRALTGDALDNLNQILTHPDAERALVLDPVRRYIHSDQLVSALWPVLSNQLQKRLVGQWRRGHSITVAKLLDECGGNRAVAEAVCEKHLDEQNTKKRKKDEPLTREAMLRNPLSVELPKGRAPHTRRVMREVVEFIFSTDRHPAEEGGPLYRSEAIRHAQLKRALDEQTNNHLVRHRLKILERLHADLLKEYAGDNPARITRINIEVNRDLREMSGKSVQEQAKLLGQQLANFKSVAKKLTEAYEGLGVHVGPGLIRKGRIAEDLHWTCPYTGKLYDALDLLHRRVDKDHIIPRSDRASDSLDSLVITFSEINKMKGKRTAVRFVEEFQGKPVEGLPQLMIKPLATYLKDMAALNTFAPHADDERRKKNRKRLLLLRDYVEKKFTPGDLTQTSQLVRLGAQALQKHYVGMEKQPAIVSLPGSVTGAVRKSWNLVGCLAAANPLVLNPDELDEDGRPKVRTKTEIRGITHLHHALDACVLGFASCFLPRDGGAWELLIKRRLNEAEQSRAKIIFGSQVEITKDGELRLADLAPALKAQICERLKERRVVQHLPADVSGLRCKETVWRVFDPADTHRNLQRLARWLKQKEVAIPAPDAKTALIICRKRRAADVSSEESAGGKVFRETKTWRWVYDIKDKSALLGLAPEGDVSAAKLKRIKAVKVLGDNFGLALDPEPTLIRPHKVWHQLETLRQRNAGKIPRLLRIGTIIRVKEKSPRSDYRGTWMVRGMSFKQRDGLVLEIAPADYVPSRRVQGVFESASVATIMKCKLEVVKVPLCGVAPSPELASHIISETKACPTTSSV

SEQ ID NO: 7326 - protein, 1171 aa, unidentified
  REGION 1..1171: note = Description of Unknown:uncultivated organism sequence
MNGKGKVLSAETDLQFAFDVGHSSIGWAVVRAPAGQTPALLGCGSVIFAADDCLASERRGFRRQRRHIRATRQRIARMRRLLGHLGVLTNKELEAPGCAWPWLLAARVLRGGKTLTWSELWDALRWYAHNRGYDGNRGWSKHAAASAEDSEKEKRAGELLMAFAKKYGRPGTMAEVFCDVLKVDPLGVVKSSTERVRNLGAAFPREGVEGEVERILRAHMGVLSQVDDRLIQALMRDHTALPSPDLPPPARYGQRLKDGSFSPGGLLFGQLVPRFDNRIIARCPITFERVYQGVKAETGDEAKAKREAEKQAKVPSVACVEFHRFRWAMELAKIKVATGNSHAPRNLTAAERQAVNAEMEKKGYLTPGELKKAVRAQTGGPPDNLDQILTHPDAERALLLDPVRQYIHNDELVSAFWPVLPQRLQKRLSGQWRRGNALTVSELLEDSGQARAGAEAVGERYLDAQNTKKRRKEEPLTRESLLRTVLRVKPTNGRAPHTRAVMREVVDFVFRTDRHPAEEGGPLYRSEAIRQAQLKRALDEQTNNHLVRHRLKLLVGETEEEARKHPKQRRLRGLFRDLVDTYAGGDLRRIARITIEVNRELRQMSGKTAQEQAKLLGQQLAHFKGVARKLAQAYEGLAVHVGPGLIRKGRIAEDLGWTCPYTGKPYDPLDLLHGRVDKDHIIPRSHRASDSLDSLVITFSEVNELKGKRTALRFVEEEQCKPVPGRPELMIKPLSTYRKDVEALETFKGHDDDQRRKKNRKRLLLLRDYVEKEFTPGDLTQTSQLVRLGAQALQKQYAGLPKQPVITSLPGSVTAAVRKSWRLTGCLAVANPQVLNPEEVDNDGRPKVRTKTEIRSITHLHHALDACVLAFASHFLPRDGGVWELLVKRRLSADEQRRARQLLGRTVEITKDGELRLADLPCKLTAQICDRLKERRVVQHLPADLSGLRCKETVWRVFDPTDPHRSTKRLARWLEEKKVPVPAGDANTALIICRKRRNAGTDREEAAGGKVFRETKTWRWVYDLKDRTALLGLAPVGDATTAKLKRIKAVKVLGDNFGLALDPEPTLIRPHKVWHQLEALRRRNGGKTARLLRLGTLIRVETKAARSDYRGTWMVRGMSFKQRDGLVLEIAPPDYVRSRRVPGVFESASVATLLKCGLEIIKPPLCGVAPG

SEQ ID NO: 7327 - protein, 1071 aa, unidentified
  REGION 1..1071: note = Description of Unknown:uncultivated organism sequence
MAQTNLQLAFDVGHSSLGWSVLQTAIRAPSQAQAPSVDILGCGVVTFRADDCLASARRVYRRQRRHIRSTRQRIARMKILLRHLGVLQKEQLDLPGCAWPWQLAARVLRGGVLLTWPELWDVLRWYAHNRGYDGNRRWSAAEAEAQKEDSEKEANARTLMGKHGVSSMAETFCKELGIEPSGKKKSSMRRFKGLNAAFPREVVEREVRKILEAHFDKLKAVDKNLEDVLFSDWRAIPCPGLKLPKRYEAGLLFGQLVPRFDNRIISKCPISGQKVPSRNCPEFLNFRWAMQLANIRVLRFGEKELAPLTVPERKQLDTLMRQQGGMGVEEFKKQVRQTTSAIRDNLDTMLMHPDAKDALLLDPVQKLIQSTELKSFWPLLPSPVQKRTRGQWRRGKNLTLAKWREQLGTDTAAFDDQVTRQLDAENIKGRKKDKQISRDEFLNRPFSVRKLDQRAAFARHLLQKAFEEVMAGRHPKEEGGCLFVTAGMRNEQLQREIAQQTNNHLVRHRLLILERLLADIVKEYAAGDKTRIARMTIEVNRDLREMSGMTAKQKAQDLGLRIANHHHVVELLEKNDSLMKALQKQKSRISASLIRKARVADDLGWMCPYTSQRFEPVDLITKRVDKDHIVPRSDRVSDSLDSLVITFSAINKWKGKRTAWQFVEQEQGKPVPDLPNLSILSLTRYRQLVNGLETFKGHDDDKRRKKRRKDLLLLPAYEEKEFTPGDLTTTSQLVRLGALSLRKAFIGCKDQPVIVSLPGSVTGTVRKAWKLLGCLSITAPLVLDENGELKTKNDIRDITHLHHALDACVLGLASHFIPNNGRVWELILKRKWTPAEENELKALGIFAKDSEGRFQMRDLDKALKDQICQRLAEKRVVQHVPARLEGLRVEQNTWRVISVKDGEATIQQRIRQSDGSRPVKDAVEKTSKLLGLEPVTGNGKLKAEKGALIIPENFGVALDPQPTIIPFHKVWTRMQELRAANFGKKPRVLRNGQLIRVPNGKNFKGIWKVFSAKNNASGMAVDIGFPDVVRLKNKTEGHKINVRLATLIKDGLEILKTPLTGIAAYPIPSSA

SEQ ID NO: 7328 - protein, 1069 aa, unidentified
  REGION 1..1069: note = Description of Unknown:uncultivated organism sequence
MKDNTPRIAFAFDVGHSSIGWSVLTAPEAGRPDILGCGVVLFEKDSALAIQRRLHRQQRRHVRATRQRIARMEKLLVHLGAFTEADLKARHTANGGSPTPWLLAARVLASRGEQTLTWPELWDVLRWYAHNRGYEPIGADEDEEENKEKRAHAREGMEHFEKSTMAETICAWLGQDPLAPRAGTIESYKAKDAAFDRVVVRDEVRRILDAHAGKLIDVDANFARALLDDANATPCPGIRLPRRYTGGLLFGRLATRYHNRIIGRCPLSGGKLPLKDCPEYYRFRWALLLANIAVATRADPTLRPLNATERAELARIAERDGYFTPAEFRKTVRTVTEAARDNLDQMFMDATAAENLVLDPALKLATSNAWIAPLWPHLPETVRRHALNRWRRGRTQSLGELRDEAMAAGAPVKAFDAALAVLCAAPAKRRGKKDPAPPPTPEQILATRFPAPLLGGRAPYARPLLIQAYREAMTGIHPRTEGGCLFETPELRRSRDTRSLDRQTNNHLVRHRLQILGRLMVQLIADPNYAAGDAARVARITLEVNRDLREMAGLTAQDIAKEMNERLRSHSQVSKRLLAELPPGTKINASLIRKARIADDLGWRCPYTGHEFEPIHLVTRKVDLDHIIPRSQRPSDSLDSLVVTFAEINKWKGNRTAWQFVHDEETKTVPGLPQFQIKQLRRYEADVAALDKRGHLDDQRRKKRRIEKLLLARYEEKAGGFTPGQLTQTSQLARLGQQVLRAPFSHLTKTPAFVALPGAITARIRAAWDVLGCLADAAPGVLEKATDAEGRERLLVKTKTEIREITHLHHALDACVLGLATARIPNRGDVWRLLLERRLNPMQRAELESLDLGDFDANGGFRLRDLPPELKKQLRCRLAERRVVQHVPADMSGLRVEENTRGIVKRENGRVFLRQRKQNAEGKFVVNFTDELESKVVGLNPVGKLTKLKGVRVIADNFGVAILDDDKLAPAERFVIIPFARVWQQLQALTERNGGKPPQVWRNGQIIELPSGPRAGRWRIFSIKNTTKMGLVLDLGAVDAIKPNWINVILKSLFRIGTRRVGSSLTGKI

SEQ ID NO: 7329 - protein, 1106 aa, unidentified
  REGION 1..1106: note = Description of Unknown:uncultivated organism sequence
MDAKEKRTPSNHPDFHLAFDVGHSSIGWAVLKRHDAEHFDRSIDIIGCGVVTFRADDCLASNRRAYRRQRRHIRSTRQRIKRLKALLAHLSVLSPEELDRPGCAWPWQLAARVLSSKSGQNPALLLSWPELWDVLRWYAHNRGYDGNRRWSATGIDSNAEREDTEKVENAQTLMHKHGAQTMAETVCAICGIDPLGSKKSSNPAPEHRFKGQNAAFPRDIVEREVQRILEVHVGKLKGLTQEVVRALVGNGSGAWKDVSCPAIKLPNRFHGSLLFGQLVPRFDNRIISKCPISGDKVPTRDCPEFLNFRWAMQLANIRVATATDRDLRTLTVEERKQVDKAIRERGYLTPTELKQAVRTATGCTRDNLENMLMHPDAKEVLLVDPVQKVIMSDELSAFWNMLPERLQKRFRGQLRRHKPVKLADIRNSLIESGMATEPFDSELQRQLDAANTKRRKRDKQTNRDELLRKSFAVAKLSGRAPFARQLLVQAVGDVMAGTHPKEEGGCLYLSESIRTAQMNRRIEQQTNNHLIRHRLLILERLIKDVIDEYADGDKGRVAIVTIEVNRDLRELSGKTAKEKAMHLESRVANHHAVAAKLEKAFAGQTFNGKPIQITAGLIRKARIAEDLGWRCPYTGQTYEPIDLVTRRVDKDHIVPRSQRAADGLDSQVITFSQVNGMKGKRTARQFIAEEQGKPVRDLPNLSILALKRFTEFVDSLESFKGHEDDKRRKKKRKDLLRVERYEEKEFVPRDLTQTSQLVRMGAQLVRKVFQDCREQPVIVSLPGSVTGTVRKSWNVLGCLSLACPQVLDETGAVRTKTDIRDITHLHHALDACVLGLASHFIPNNGRVWELIIKRKLSDAEKRQLLVLGVFGFDTDNRFQLRDLSDQLKKQIRERLAERRAVQHLPSRMGSLRAEQNTWRVIAVKDGQATIQQSMRAPNGSRVLKKATEKIGKLLGLDPEGSGKLRAIKGALVIPDNYGLAILDHAASTEDRVVIVPHHKVWHRLNDLRIRNRGHWPRVLRPGSLVRLRNTKPAGKRDGIWRVYTAQASLKIDLVWADSVERKKKGTDVWREVSIANLGLHNIEVLPRRLSGFPQHGSVRCPTISSA

SEQ ID NO: 7330 - protein, 1510 aa, unidentified
  REGION 1..1510: note = Description of Unknown:uncultivated organism sequence
MNDKEKNLPANKYGEADLELAFDVGHSSVGWAVLDNNSEFCSASFSFPGVRASGVLLFPSDDCLASVRRQLRGQRRHARATRKRIERIARFLLRVLSKKQKSNATLIKHLEYYLDSNPQNRANLQGKGHPAPWLLAARVLCGGDLLDWSQFWDVLRWYAHNRGYDDNVPWARQSENRSPSDQAQQAQEQDRKRQARAIALMKCYGTKRMAETVFCYLFDEADSGRCDFDPRKVDRLPFFQRYFKEEECIFPRETVKEEVRQILNAHRTMIESAGISPNIFIDALLDDWRVLPEEFLGTPESKNRIWLPKRYGTRKTRHLPDGRVRQERTHAGLLFGQLIPRFENRIISTCPFTFARRYIQFLNQGVTEEQWRLLPKSWKSRIRPHQSLAEEIARHLARIAAKVPTRASREFLQYRWTMLLADLAILGKSNVVSRRLSANERKHLDNEMQKRGTFSVDELRELISIAAPGCEAANLDDIFHETPERAKELFVDPAKNFAASSELAKNLFPLLPDRLQRRVLNELRRGRSLKPSSLLELLKQFGYVKEASDFEAKVQWLQDAENLNANRGGRGKSMISARKAKSRSVPILERILKLKPLSGRARYHREILKQAAQEVLDGFDPNKKALDPKNPDDKSEQKTKDGCLVETPEMVSLALGHASSGESAETAFPSWLEKWRKKRSRRGELANETLFQKYGEACAREVYEARTSNQWLSGQTNNHLLRQRLLLLRRLTDDIIVEFANGKAERIAGVTIEVARDLLAFSGLQKKDIGSDTKGALKSIKAQHYRVEEKLRREFAPEGKEYLITGELLWKAKIADDLGWRCPYTNDPISGFQLAKGEMDIDHIIPRSKRLTNAMEACVITYKGINQKKKNMTALEFVTRFQTKHIGSLTKGIRRLDDYLNFVKNLKLCRPPKARTQTNGESELNEEFENDNTGAIELNPKYLPGTDRLHPDYIRRRKRQRLLKIKSASDEDLGFTRRDLTITSHLNRLAQFALLRALPHLRPNDFVSLPGVVTGSVRDMGGWQLLGLLGRPNVCGERAMRKVKKINYETKEIERNPQTGEELWKEVPRKKNELRKLTHLHHAIDACTLGMLAHILPKDGKLWEYIAVGDLTEIQAADFGKRSQEFKRRGHPFSSLFTLVPIPENEREEESEKPRTHRVRSIWNKQNKELLHWVKESIGSALEARRVRLHIPAERNGMPTNQTVYRVLTSLNAPGYIPQLARAVLSAKEEQLKRLDEAVANEKNKGRLKKLSLERDALAKLLNRLKDFVQNVWLINRVRKDSETGKDVINRLKEYEDWRRRNNGERAPEAADETSQEDLDADAEEDAAKSKKSNRKKREPNLLRPFNPDKHKLLYLFDVVSRDRVIGLPPDNKIAQARLLPLKAGKELGANFAAVIFPPIEVNGEKQWRDGKEIIVLPFFRVHHSLEQLKAQGKKIQLLRNGALIHVPKGDRYGWWRVISVKDTEAYGKAVDLAAPDGVEKIKGNAPLTVLLKEGMKIISSPLTGHDIRR

SEQ ID NO: 7331 - protein, 1064 aa, unidentified
  REGION 1..1064: note = Description of Unknown:uncultivated organism sequence
MKDLELAFDVGHSSIGWAILQADPSLEIKGCGAVIFRADDCLASKRRDFRRQRRHIRSTRQRIRRMKALLLHLAILTQKQLDKPGCGWPWKLAARVLVGGEPLTWPELWDVLRWYAHNRGYDGNRRWSGQNDEDAEDAEKVVNAHTLLDKHNVKTMAETFCKVLGVDPLGAKSSSIVRFKGLNAAFPRDIVEAEVRRILQAHFGKLKSVDEKFATALFSNWKSLPCPVIKLPQRYYGGLLFGQLVPRFDNRIIASCPVTYAQEYEKLCTGGMSHDKAAERARIVAKVPSRNTPEFLNFRWGMLLANVRVARLGNTGLQPLTPAERKELDKRMRAVGSMTEKQFKDAVRDVSGAIRGNFDTMFMEVNQKEALILDPVQDCLTSGHAASLYPTLPERIQKRARGQLRRGKTLILGDLGKDVTAFDAAMQQILDKVAGKGRKKDKPLTHGEILGVRLQAKKLSGRAAYARPILVKAFEEVMAGKHPKEENGCLFVTEKIREAQLNRSLTDQTNNHLVQHRLLILGRLLSDMLKEYAGGDKARVGKITIEVNRDLREFSGKTAKEIAKDLGSRLANHHHVTEKLEAALGSHSRITAGLIRKARIAEDLGWTCPYTGQMYEPIDLVTRRVDKDHIVPRADRASDSLDSLVITFSAVNKWKGKRTAVQFIQEEQTKPVPDLPNLSVISLTRYRDFVAGLESFKGHNDDKKRKKRRKELMLLADYNEPEFTPRDLTVTSQLVRLGAQVLRKAFDDCEDKPVIVSLPGAVTGEVRKAWDVLGCLSLACPQVLDETGKVKTKKEVRDLTHLHHALDACVLGLAAHHIPNNGRVWELITKRNLTTAEQAELVKLKVFSVVGERRAELNDLSRERKEQIRQRLAEKRVVQHIPKRVSGLHVEQNTWRVRGINGDDVLLEQRIRQPDGTRPLKQASERAGKLMGLEPGKLHTLQGALVIGDNFGVALDPVPTVIPFHKVWPRLQELKAKNSGKMPRVLRNGQLIQVPSGAFKGTWKVFSAKNNKTGMALDIGHPDVVRLKNKTDGHKINVLLSTLLKNGIIGLNTPLTGVAATDTT

SEQ ID NO: 7332 - protein, 1172 aa, unidentified
  REGION 1..1172: note = Description of Unknown:uncultivated organism sequence
MGNNSASANLELAFDVGHSSLGWAVLQSSLSPISHPPSPTLLGCGAVTFGADDCLASVRRGFRRQRRHIRATRLRIARLKRLLAHLRVLSPTQLDAVASSSPWLLAARVLRSGSKLTWEELWDVLRWYAHNRGYDGNKGWSRQDLTANPEDTEKEQKAHELLDAFRAKHGRDGTMAEVLCDRLGLDPLAAKQSSAIRFRDLGAAFPREGVEAEVERLLRAHLGMLPGVDEAFIIAVMRDHTVIVGPDYRLPARYGQRVGSTRTPGGLLFGQLVPRFDNRIIATCPVQFQRVYDRVLAETGNASKATFEAHKLAKVPGVGCVEFHRFRWAMQLANVTIATGDARKSRRLSKEERNALNADMEKHGALTPSEFKKAVRALTGTNKDNLDRLLALPDADKSLVLDPARKLVASGVLGILWPHLVESLQKHTLTNLRRGKATTVRALLDKCPAAAPAFDHWWDGEAMKKPRKPRTGETATVRTRAQALDEAHALAPANGRAAHSREVMADVWQFVLAGDGHPMDPGGPLFRSEAIRRAQLDRVIDEQTNNHLVRHRLKLLERLHEHLLTEFAAGDPTRVSRITIEVNRNLKELSGKTAQEQAKEQGQQTAQFRSVEKKLNAAYEGLGVKLGPGLIRKGRIAEDLGWQCPYTGATYDELDLLHRRVDKDHIVPRSQRTSDSLDSLVITFSEINKLKGQRTAVQFVEEFQSKPIPGLPNLMVKTLSNFLRDVEGLDTFKGHDDDKRRKKNRQRLLKLRDSVEKEFTPGDLTKTSQLVRLGAEALQRAYLNTNAKPVIVSLPGAVTAAARKSWNLLGCLTAANPNVLNAEDLDDHGKPRIHRKTELRGISHLHHALDASTIAFTSHLLPCDGGVWKREAIELLAKRRCNTMEQAQLRAMLRWNVSFTQEGQPVLAELPDELREQLRARLAERRVVQHLPASMGDMVSDQTVWRVFDPADPHPNARRLARWLAAAEVEVPKPDAPTVIIITRKRKAPPKPSEEAKAKKGKFHEGKTWEWYYVAAAKDALLGFAPSGDPAKAKLKPLKAVKVLGDNFGIALDPEPTLLRPLHVWRQMTALKAANGGKWPRVLRNGMLIRVPRAKTAKVDYRGTWMLRGVQVNQAKGFLVDLSPTDQIRYRGEDGCFQNVSLETLLKCGLEILKPTLCGVAQASSVPTTSVG

SEQ ID NO: 7333 - protein, 1172 aa, unidentified
  REGION 1..1172: note = Description of Unknown:uncultivated organism sequence
MGNNSASANLELAFDVGHSSLGWAVLQSSLSPISHPPSPTLLGCGAVTFGADDCLASVRRGFRRQRRHIRATRLRIARLKRLLAHLRVLSPTQLDAVASSSPWLLAARVLRSGSKLTWEELWDVLRWYAHTRGYDGNKGWSRQDLTANPEDTEKEQKAHELLDAFRAKHGRDGTMAEVLCDRLGLDPLAAKQSSAIRFRDLGAAFPREGVEAEVERLLRAHLGMLPGVDEAFIIAVMRDHTVIVGPDYRLPARYGQRVGSTRTPGGLLFGQLVPRFDNRIIATCPVQFQRVYDRVLAETGNASKATFEAHKLAKVPGVGCVEFHRFRWAMQLANVTIATGDARKSRRLSKEERNALNADMEKHGALTPSEFKKAVRALTGTNKDNLDRLLALPDADKSLVLDPARKLVASGVLGILWPHLVESLQKHTLTNLRRGKATTVRALLDKCPAAAPAFDHWWDGEAMKKPRKPRTGETATVRTRAQALDEAHALAPANGRAAHSREVMADVWQFVLAGDGHPMDPGGPLFRSEAIRRAQLDRVIDEQTNNHLVRHRLKLLERLHEHLLTEFAAGDPTRVSRITIEVNRNLKELSGKTAQEQAKEQGQQTAQFRSVEKKLNAAYEGLGVKLGPGLIRKGRIAEDLGWQCPYTGATYDELDLLHRRVDKDHIVPRSQRTSDSLDSLVITFSEINKLKGQRTAVQFVEEFQSKPIPGLPNLMVKTLSNFLRDVEGLDTFKGHDDDKRRKKNRQRLLKLRDSVEKEFTPGDLTKTSQLVRLGAEALQRAYLNTNAKPVIVSLPGAVTAAARKSWNLLGCLTAANPNVLNAEDLDDHGKPRIHRKTELRGISHLHHALDASTIAFTSHLLPCDGGVWKREAIELLAKRRCNTMEQAQLRAMLRWNVSFTQEGQPVLAELPDELREQLRARLAERRVVQHLPASMGDMVSDQTVWRVFDPADPHPNARRLARWLAAAEVEVPKPDAPTVIIITRKRKAPPKPSEEAKAKKGKFHEGKTWEWYYVAAAKDALLGFAPSGDPAKAKLKPLKAVKVLGDNFGIALDPEPTLLRPLHVWRQMTALKAANGGKWPRVLRNGMLIRVPRAKTAKVDYRGTWMLRGVQVNQAKGFLVDLSPTDQIRYRGEDGCFQNVSLETLLKCGLEILKPTLCGVAQASSVPTTSVG

SEQ ID NO: 7334 - protein, 1063 aa, unidentified
  REGION 1..1063: note = Description of Unknown:uncultivated organism sequence
MSATGKRDLIFSFDVGHSSIGWNVLKETENKPEEVALGTVTFESDGCLASKRRVHRGMRRNIRSRRLRIADIEKLFVHQGILSAEEIEEKHKPGAGSSSPWLLSAAVLASGGNFTLKADELFDMVRWYAHNRGYDGNRRWAHNVEDQEGDSKREQSAFALMDEHKTSTMAETICAQLGLTPGGQQKASMAAYKDSEIGAAFTRKIVVAEVVRVLQAHLGKINGCSTEFIDALCGQDDEAWKTITVPNLGKPKTYRGGLLFGQKIPRFDNRILSFCPVSDKPTPLKSCAEFMDFRGAMFLSNVRVGASAGFDLRPLSSDELNSLWAKMKERGYLTAKQFKDAVRALAGVEKDNLEALMMIEPADKNLVIDPSLKLLSSSTVLKSIVSLLSRPVRDEILSSLRKKHGVTIFEMIAEVPASAEMNQALNAAFKKDTKGQKKYGIQDRWVNERTFGAEFDSGRAPYGRPVMTQAVEEILSGKDPRAEGGCLYLTEEMLKRHEGRSLADLTNNHLVRHRLMILQRLFKDMVKEFCDGDKERILSVVVEVNREVSSMSGKSMKLIKQEEGLKRADHNKASKLMEAAVEESGENIRVGAGLIRKARVAQDLNWTCPYTGEIFDPLALIHSQVDLDHIIPRSERLSDAMAGLVVTFSEINRWKGARTAYQFISEEQGRRVPGKPNLSIMSLKSYEEFVGKLKISGVHDADVGRRKARKGYLMLPSYQDKEFTPRDLTISSYVAKLAVGQIKKEFSELTRRPSVISLPGRLTGEARKAWKLLGLLSAVNENITGETPKNDIRGLTHLHHALDAAVMGLMAHCADNLSDGTTWQLLLKRNLRPDEKNRLKANMRNIAFDGNRAHLLDVPDGIKKQLQKCLMERRVVQHVPASMDGLKVEENTRGVVGFDEEKGKVKLRQMGNETEEVSGKLVGYKTDGSKLEKQKGVRVINQNFGVALTSPPQIITWHKVFPKLKEIEQETGTWPQVLRNGMLICVPEGNYAKVSKVWKIFSLKNNASGMAVDMGYADSIKPFKINVLLKSLIKDGLRLVESNFSGEGICHITSSILAVQPSD

SEQ ID NO: 7335 - protein, 1078 aa, unidentified
  REGION 1..1078: note = Description of Unknown:uncultivated organism sequence
MSIALSFDIGHSSVGWAALNLSHHQPEVLGCGAVTFPAEDCQNQQRAGFRRQRRHIAATRNRIKRLESFLVQVGAIAAEDVEYCREHPNPWPWLLAAQVIVNNRELNWRELWAVIRWYAHNRGYDGNALWAGEDSDPDVKKVQAARGLMDRCDTGSMCETICELMDIDLKSDQNPTLRHYFKGENAAFPRDVVVAEVRQVLERHLGGLTGVTQELIRALLDDWQCASEVGFDAKLPVRYFGGLLFGQMKPRFENRIIPTCRITGEKTPSKHSRAFYRFRWAMLMGNLRVVDQFESGSRALSRLEREQLNTVMEDAGYMTKTTLKKALEQDLGLEPSNLDAMLLIPEMEKALTLDPALREMSGTKYKKIWKKIPDSWQPTFLNQLFNARNYRSKPASLAQWRSRIEAKGELSDEFDAVLREAYDAECETLAKKKGAGALPTYQGFLNRPLRIAQEHMASGRAPYARVKLVEAVAAVMKGEEDPRAVGGALEESIAVRERQQNIGIDQSSNNHLVRHRLKIFEKTLIDLVNHYAEGDASRVEWVGVEVVRDIVEFSGKTAKEKAKILGEQLWHHRKISKYLEEEKESSEGSWDINAGLIKKVRIADDLDWKCPYTGQLYNLNQIIHGDVDREHIIPRSKRPTDAMHALVLTFSELNREKGARTAMQFIEDTKDDSRTLTPKQFQEFVSKLKKSNGPSKDDERRCMKRKIALLTCDYEPRGKAKEKSDGESVDGFTEGSLTQTSYINKLAAQQVLHWFSKQVETGAKLPEVIQLSGSVTAATRRGWNLFGSLEEACPETRGKSKTEIREITHLHHALDAIVIGLSAYYFPKDGRLWALLSKRSIGKPADQTYLRTQLGDLISFSSSGSWQLEPLKEPLMMQIVERLKEKRVVRHNPRTMRGLRIQQNVWRVEAEDPDDPSKMLIRMKPRNEDGVKVEKQKSERKTKLFGSSPKGATGKLKDLKGALIVEDNYGVALDPEPKVIPYQQVWGQIQHLRKQNGGRPIRVLRNGNIIRVKEGRYAGLWRVHSIKDANMGLVLDIASPELVRAGNGVVGAKMNVRLNTLLSNGLELLNLDSSSHEF

SEQ ID NO: 7336 - protein, 1078 aa, unidentified
  REGION 1..1078: note = Description of Unknown:uncultivated organism sequence
MNSKQESSPGATSAPDLQIAFDVGHSSIGWAVLQTTNGKSRRDLSINLLGCGAVTFRADDCLASARRAYRRQRRHIRSTRQRIARLKVLLAKLGVLTEAELDKPGCAWPWLLAARVLTGGELLAWPELWDVLRWYAHNRGYDGNRRWSAVEAEAQAEDSEKEANARSLMGKHNTKSMAETFCKELGLDPRGTAKASRKRFKGLNAAFPREVVEAEVRQVLRAHFGKLLKVDANFERALLGKVNNDELAWQAIPCPGLKLPKRYKGGLLFGQLVPRFDNRIISTCPISGQKVPSRNCPEFLNFRWAMQLANVQVARFGEQKLSALKPAERVELDKKMRAVGGMTVKEFTEAVRSTTGAIRDNLDTMFMHPDAKEALLLDPVQKLVCSDELAPFWTLLPERLQKRLRGQWRCGKVFTLEQIRSQLEPLGNVHAFDAELQNQLDTRNTKTKKKDKHITLEELLKRPFPPKPLKLDGRAAFARDLLKQAYEEVLAGKHPKEKGNCLFLSEAIRKQQQERAIADQTNNHLVRHRLLILERLVGDIVKEYAGGDRERIGKATIEVNRDLREMSGKTAKEKAQDLGLRIANHHAVSDKLEKAFAAEGLRIPITAGLIRKARVAEDLGWRCPYTGQLYEPKQLVSRYVDKDHIVPRSQRPSDSLDSLVITFGAINKWKGNRTAWEFVAQEQGKSVPDLPNLSIMSLARYKQFIEGLESYRGHGDDKKRKKRRKELMLLPKYVEKEFVPRDLTQTSQLVRLGAQVLRKVLPHLNQNDVVSLPGSVTGAVRKAWKILSCLSLANPQVLGEEGNVKTKTEIRNITHLHHALDACVLGLTSHFIPNNGQVWQLIVKRNPNEMEKKQLTALRVFEFNKDNRFEMRDLDDRLKEQLRQRLAEKRVVQHVPARMDGLRAEQNIWRVLEVKEGRAIIQQRIRQADGSRPLKRTEEKVGKLLGLEPGKLSVNKGVLVLPDNFGIALEPQPTIVPFHKVWMRLKALRKANNGKMPRVLRNGQIIQVPTGRYKGIWRLFSAKATLTLDLGTPDKVRLESKGDGQKREVQIKTLIKDGMLVRKTPLTGIAAHLTAPSS

SEQ ID NO: 7337 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRGLLAHLGVLTPAQLAAPGGAWPWLLAARVLVCAAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRARNLGAAFPREGVEAEVERILQAHKGILPGVDDPLIHALLCDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPHPRNLSAAERNDIHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLAAEAAKKKRAPDAPRTPAALAGRVLRVERARGRAPHTREIMREAVAFVLATDRHPAEEGGPLYRSDAIREAQLRRALDEQTNNHLVRHRLKLLAGDADAGPRALNGLFRDLADTYAGGDLGRIGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLALANPLALNPDDPDDHGRPLPHKKTELRKITHLHHALDACVLALAAHLLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRIGSLIRVNQKTGRSDYRGTWRVRGIQLSQRSGCLVDLSPPDQILYRGQPGSFQNVSVATLLKCGLEILKTPLSGVAAPP

SEQ ID NO: 7338 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLVCAAPLTWPELWDVLRWYAHNRGYDANRAWSRQEKPDTEDSEKAQRAHELLREFARRHDRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLAAEAAKKKRAPDAPRTPAALAGRVLRVERARGRAPHTREVMREAVAFVLNTDRHPAEEGGPLYRSDAIREAQLRRALDEQTNNHLVRHRLKLLAGDDAAGPRALNGLFRDLADTYAGGDLGRIGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLALANPLALNPDDPDDHGRPLPHKKTELRKITHLHHALDACVLALAAHLLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 7339 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLVCAAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLCDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPHPRNLSAAERNDIHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLAAEAAKKKRAPDAPRTPAALAGRVLRVERARGRAPHTREIMREAVAFVLNTDRHPAEEGGPLYRSDAIREAQLRRALDEQTNNHLVRHRLKLLAGDADAGPRALNGLFRDLADTYAGGDLGRIGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLALANPLALNPDDPDDHGRPLPHKKTELRKITHLHHALDACVLALAAHLLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 7340 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRGLLAHLGVLTPAQLAAPGGAWPWLLAARALGGGAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRARNLGAAFPREGVEAEVERILQAHKGILPGVDDPLIHALLCDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPHPRNLSAAERNDIHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLAAEAAKKKRAPDAPRTPAALAGRVLRVERARGRAPHTREVMREAVAFVLATDRHPAEEGGPLYRSDAIREAQLRRALDEQTNNHLVRHRLKLLAGDADAGPRALNGLFRDLADTYAGGDLGRIGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLALANPLALNPDDPDDHGRPLPHKKTELRKITHLHHALDACVLALAAHLLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRIGSLIRVNQKTGRSDYRGTWRVRGIQLSQRSGCLVDLSPPDQILYRGQPGSFQNVSVATLLKCGLEILKTPLSGVAAPP

SEQ ID NO: 7341 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLEAEAAKKKRTPDAPRIPDAPAGRVLRVERARGRAPHTREIMREAVAFVLATDRHPAEEGGPLYRSDAIREAQLRRALDEQTNNHLVRHRLKLLAGDADAGPRALNGLFRDLADTYAGGDLGRIGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLALANPLALNPDDPDDHGRPLPHKKTELRKITHLHHALDACVLALAAHLLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPTWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 7342 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLVCAAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGPRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLEAEAAKKKRAPDPPRIPDAPAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYADLGVRVGPGLIRKGRIAEDLGWTCPYTGQPYDALDLLHRRVDKDHIIPRSDRASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANENIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRIGSLIRVNQKTGRSDYRGTWRVRGVHLNQRAGYLVNLSPPDQIRYVGQDGCFQNVSVATLLKCGLEILKTPLSGVAAPP

SEQ ID NO: 7343 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLVCAAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLCDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLEAEAAKKKRAPDPPRIPDAPAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYADLGVRVGPGLIRKGRIAEDLGWTCPYTGQPYDALDLLHRRVDKDHIIPRSDRASDSLDSLVITFAEVNKWKGQRTALRFIEEEQGEPVPGLPQLSLRTLAAYRQAVEKLECSKGHENDQRRKRNRKRLLLLRHYVEKEFTPADLTQTSQLVRLCAQALQRLCLGRARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANENIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRIGSLIRVNQKTGRSDYRGTWRVRGVHLNQRAGYLVNLSPPDQIRYVGQDGCFQNVSVATLLKCGLEILKTPLSGVAAPP

SEQ ID NO: 7344 - protein, 1076 aa, unidentified
  REGION 1..1076: note = Description of Unknown:uncultivated organism sequence
MKDKQKNTLSQTADLELAFDVGHSSIGWAVLQSVSPAPAQTETPSVNLLGCGVVTFGANDCLASHRRAFRRQRRHIRSTRQRIARIKILLKQLGVLDEATLNQPGCAWPWRLAAQVLQGGKRLTWAELWDVLRWYAHNRGYDANRRWSAAEAQAQQEDSEKEANARTLMDKHRTKSMAETFCRELGIDLSGKKKSSTKRFKGLKAAFPREIVENEVRKILQAHHDILPGVDGRLEEALFTNWQAIPCPNLKLPNRFQGGLLFGQLVPRFDNRIISQCPISGQKVPSRNSNEFLNFRWAMQLANVRIARFGELKLSPLSPGERRELDQQMRRVGAMTAEQFKKTVRNVSNAIQDNLDTMLMHPDAKEALTLDPVQKLVRSTELAPFWELLPERLQSRLRGQWRRGKVFSLAQIRTQLAGYGDVAAFDTAVQKQLEARHVKSRKKDKPLTREDLLERQFPPQPIKLAGRAAFARPLLQQAYAEVMDGQHPKEPGGCLFLSEEIRQRQLAREIAAQTNNHLVRHRLLILERLLNGIINEYAGKDKTRIGKITIEVNRDLRAMSGKTAKEKAQDLNRRIDNHHAVAAKLEKAFAEENTRIPITAGLIRKARIAEDLGWKCPYTGQDYEPRQLVSRYVDKDHIVPRSHRASDALDSLVITFSAINKWKSNRTAWEFVEQEQGKPVPDLPHLSIMSLSRYRQFVESLETYKGRHDDDKKRKKRRKELLLLPKYEDKEFTPRDLTQTSQLVRLGAQVLKRAFAGHEQPPIIVSLPGSVTAAVRKAWKILGCLSLANPQVLDENGEVKNKTDIRGITHLHHALDACALGLASHFIPNHGRVWELIVKRTVNDAEKEELMALGIFTFSANHRFEMRDLDNRLKEQIRQRLAEKRVVQHVPARMGGLRVEQNTWRVVEVKAGKARIQQRIRQADESRPLKQTEEKTSKLLGLQPGKLSVNKGVLIIPDNYGVALDPEPTIIPFHKVWERLRELKKANGGKRPRVLRNGQLVKVPQGKFMGVWRVFSVKNNTSGIAVDLGFPDVVRLKNKMAGHKINVLLASLLKNGMRVVKPPLTGVPTWPTTSSA

SEQ ID NO: 7345 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGRAPDNLDRLLALPDAERALVLDPVRLYCHRDPLLSVLWPALPARLQRRLRGQWRRGRALTVADVLAACGDARPAAEAALAQYLEAEAAKKKRAPDAPRIPDAPAGRVLRVERARGRAPHTREIMREAVAFVLATDRHPAEEGGPLYRSDAIREAQLRRALDEQTNNHLVRHRLKLLAGDADAGPRALNGLFRDLADTYAGGDLGRIGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLALANPLALNPDDPDDHGRPLPHKKTELRKITHLHHALDACVLALAAHLLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVKQPGSFQNVSVATLLKCGLEILKTPLSGVAAPR

SEQ ID NO: 7346 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGRAPDNLDRLLALPDAERALVLDPVRLYCHRDPLLSVLWPALPARLQRRLRGQWRRGRALTVADVLAACGDARPAAEAALAQYLEAEAAKKKRAPDAPRIPDAPAGRVLRVERARGRAPHTREIMREAVAFVLATDRHPAEEGGPLYRSDAIREAQLRRALDEQTNNHLVRHRLKLLAGDADAGPRALNGLFRDLADTYAGGDLGRIGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKEFTPADLTQTSQLVRLCAQALQRLCLGRARPPVVTALPGAVTAAVRKAWNLTGCLALANPLALNPDDPDDHGRPLPHKKTELRKITHLHHALDACVLALAAHLLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 7347 - protein, 1168 aa, unidentified
  REGION 1..1168: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLGVDPRGPVKSSRQRVRHLGAAFPREGVEAEVERILQAHKDILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGRAPDNLDRLLALPDAERALVLDPVRLYCHRDPLLSVLWPALPARLQRRLRGQWRRGRALTVADVLAACGDARPAAEAALAQYLEAEAAKKKRAPDAPRIPDTPAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYAGLGVRVDPGLIRKGRIAEDLGWTCPYTGQPYDALDLLHRRVDKDHIIPRSERASDSLDSLVITFAEVNKWKGQRTALRFIEEEQGKPVPGLPQLSLRTLAAYRQAVEKLECFKGHENDQRRKRNRKRLLLLRHYVEKEFTPADLTQTSQLVRLCAQALQRLGLGCARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCDETVWRVFDPADPHPNARRLARWLANKNIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRIGSLIRVNQKTGRSDYRGTWRVRGVHLNQRAGYLVNLSPPDQIRYVGQDGCFQNVSVATLLKCGLEILKTPLSGVAAPP

SEQ ID NO: 7348 - protein, 1173 aa, unidentified
  REGION 1..1173: note = Description of Unknown:uncultivated organism sequence
MSDKGNNSAVTVPDLSLAFDVGHSSIGWAVLQARAGQHPALLGCGAVIFAADDCLASVRRGFRRQRRHIRATRQRIARMRRLLAHLGVLGDGQLEAPGCAWPWLLAARVLRGGKALSWPELWDVLRWYAHNRGYDGNRGWSRQDEASAEDSEKEKRAGELLAEFERKHGRQGTMAEVFCDKLEVDPLGEVKSSMRRVRDLGAAFPREGVEAEVERILRAHAGVLPQVDDRLINALMRDHTALPTPDRPPPARYGQRLGDGSLSPGGLLFGQLVPRFDNRIIARCPITFERVYQAAKAETGDEENARHEAEKRAKVPSARCVEFHRFRWAMELAKIKIAAAGKGEPRNLTAAERRAVNAAMEQKGYLTKSELTGAVRGQTGGLPDNLDQILTHPDAERALVLDPVRRYIHGEQLVSALWPVLPERVQKRLRGQWRRGHGINVGEVLEACGGARPAAEAACERYLDAQNTKKRRKDAPLTGEALRRRVLRVELPKGRAPYTRPVMREVADFVLGTDRHPSEEGGPLYRSEAIRQAQLQRALDEQTNNHLVRHRLKLLVGDAEAKAGKRPGRRKLNGLFRDLADTYAGGNLGRIGRITIEVNRELREMSGKTAQEQATLLGRQLAHFKGVAKKLAQAYEGLGVHVGPGLIRKGRIAEDLGWACPYTGKLYDALDLLHRRVDKDHIVPRAERASDSLDSLVITFAEVNKWKGKRTARRFVEEEQGKAVPGLPQLTIKSLAAYLKDVEALETFKGHEDDQRRKKNRKRLLLVRDYVEKEFTPGDLTQTSQLVRLCAQALEREYLGLDHKPVVTSLPGAVTGAVRKSWSLSGCLAAVNPLVLNPNDPGQDGKPGVRTKTEIRSITHLHHALDACVLGFASHVLPRDGGAWELLVKRRLGADEQRRARQLLGGAAAITQEGELRLADLAPALKEQICGRLKERRVVQHLPADLSGLRCKETVWRVFDPEDTHPNARRLARWLVEEKVPVPAPEARTALIICRKRRNAGADGEDAAGGKVFRETKTWQWVYDIKDKTALLGLAPEGDAAAAKLKRIKAVKVLGDNFGLALDPEPTLIRPHKVWHQLNALRLRNGGKPPRLLRIGSLVQVRQKTPRSDYRGVWMVRGVQLDQRAGYLLDLSPADQILYRGQPGCFRNVSVATLLKCGLDILKVPLTGVAPAQ

SEQ ID NO: 7349 - protein, 1168 aa, unidentified
  REGION 1..1168: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLGVDPRGPVKSSRQRVRHLGAAFPREGVEAEVERILQAHKDILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLAAEAAKKKRAPDAPRTPAALAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYAGLGVRVGPGLIRKGRIAEDLGWTCPYTGQPYDALALLHRRVDKDHIIPRSERASDSLDSLVITFAEVNKWKGQRTALRFIEEEQGKPVPGLPQLSLRTLAAYRQAVEKLECFKGHENDQRRKRNRKRLLLLRHYVEKEFTPADLTQTSQLVRLCAQALQRLGLGCARPPVVTALPSAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCDETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 7350 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARALGGGAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLAAEAAKKKRAPDAPRTPAALAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYADLGVRVGPGLIRKGRIAEDLGWTCPYTGQPYDALDLLHRRVDKDHIIPRSERASDSLDSLVITFAEVNKWKGQRTALRFIEEEQGEPVPGLPQLSLRTLAAYRQAVEKLECSKGHENDQRRKRNRKRRLLLRHYVEKDFTPADLTQTSQLVRLCAQALQRLGLGCARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRKGTLIRVNQKSARSDYRGTWRVRGVQLNQRAGYLVDLSPPDQIHYVRQRGSFRNVSVATLLKCGLEILKTPLSGVAAPP

SEQ ID NO: 7351 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLVCAAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGPRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLEAEAAKKKRAPDPPRIPDAPAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYADLGVRVGPGLIRKGRIAEDLGWTCPYTGQPYDALDLLHRRVDKDHIIPRSDRASDSLDSLVITFAEVNKWKGQRTALRFIEEEQGEPVPGLPQLSLRTLAAYRQAVEKLECSKGHENDQRRKRNRKRRLLLRHYVEKDFTPADLTQTSQLVRLCAQALQRLGLGCARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANENIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRIGSLIRVNQKTGRSDYRGTWRVRGVHLNQRAGYLVNLSPPDQIRYVGQDGCFQNVSVATLLKCGLEILKTPLSGVAAPP

SEQ ID NO: 7352 - protein, 1168 aa, unidentified
  REGION 1..1168: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLGVDPRGPVKSSRQRVRHLGAAFPREGVEAEVERILQAHKDILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGRAPDNLDRLLALPDAERALVLDPVRLYCHRDPLLSVLWPALPARLQRRLRGQWRRGRALTVADVLAACGDARPAAEAALAQYLAAEAAKKKRAPDAPRTPAALAGRVLRVERARGRAPHTREIMREAVAFVLATDRHPAEEGGPLYRSDAIREAQLRRALDEQTNNHLVRHRLKLLAGDADAGPRALNGLFRDLADTYAGGDLGRLGRITIEVNRDLRELSGKTAQEQAQLIGQQLANFKSVEKKLTEAYAGLGVRVGPGLIRKGRIAEDLGWTCPYTGQPYDALALLHRRVDKDHIIPRSERASDSLDSLVITFAEVNKWKGQRTARRFIEEEQGKPVPGLPQLSLRTPAAYQQAVEKLECFKGHENDQRRKRNRKRLLLLRHYVEKDFTPADLTQTSQLVRLCAQALQRLGLGCARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 7353 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGLRLPARYGQRQPDGTLRPGGLLFGQLLPRFDNRIIARCPIAYERVYQQVLTETGDREKARREAEKRAKVPAAHDADFHRFRWAMVLAQINIAVPGAPQPRNLSAPERNSLHSVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLEAEAAKKKRAPDPPRIPDAPAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTALRFIEEEQGKPVPGLPQLSLRTLAAYRQAVEKLECFKGHENDQRRKRNRKRRLLLRHYVEKDFTPADLTQTSQLVRLCAQALQRLGLGCARPPVVTALPGAVTAAVRKAWNLTGCLAQANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 7354 - protein, 1106 aa, unidentified
  REGION 1..1106: note = Description of Unknown:uncultivated organism sequence
MEQILAHLGVMTARELKDRHEQAGGDSFAWQRAAEILSAARGGKPLPQINWLELWDMLRWYAHNRGYFAPPWANRGEEEVLDDDEVPDSEKVEIGRARMRELGTTTMAETTAAYTAWYEREVARWQQKQRPDKPAHFKGLKAAFQRESVVWPEVAALLHALQGRLAKLDDDLIRTLLANDVDPLKDPDAWRTIACPAIKLPKRYHGGLLFGQSIPRFDNRIIGVCPIRFARLTSKYLGEGLESGEAKRCAEKESKLPSKASPEFLRFRWAMQLANIFGAAPGERDTRPLTAPERKLLTEQAGRQGAFTKGEFKKVVRAIAGWAEKGGRDNLDNLLLHPDAEKALELDPAQAAIAGSQLAASLGALPERYRKRLHGKLERGQSVRLADVRAWLEKADGPRVQPTASAPSVPDDLVAFDAGVQRVLDTAATRRSKKQSPLTREALLDEKLTAKYPKGRAPYSRPILREAFDEVMKGWDPRAEKNDHQPRGCLCQTNELKEAQLQRRLEEQTNNHLIRHRLLILERLQRDLIAAPEFANGDRARIAGITIEVNRDLRDLSSKTREEQKLDLGLRLSDFKRVAAKVEEACRRRNIPVTAGLIRKARVAEDLGWHCPYTGRQFNMDTLLDGVMDKDHIIPHADRQSDSLDSLVITWAEINKWKGKRTAMEFIRDEGGKPVPGLRGVEVMSLAEFQKHVAGLDIRKGHDDDRARKKRRIRRLLTEHYEEKEFTPRDLTVTSQLVRLGAQVLQRAFPPEQRAPVVSLPGSLTGEVRKAWKLLGCLGAANPAIFEADGKTPKRKDDIRGITHLHHALDACVLGLAALFFPRHGTVWSAMVKAGGDREADEDRRLWLAMTKRRPTAAEAALLKATGLYRQDSEGRLHLSDLPDALKQQIRSRLAEKRVVQHIPADMSGVKIEENTRGVVGEKDGRVLLRQRSARDAKTGLQTVKRTGEAPGKLLGLNPTGSDGKLKRQKGARVITDNFGVAILDHALGGEEFAVIPWHRVWHRLQALKAMNGGEPPRILRNGMLIKVAAGTYQGLWRVISAKDTQAYGKVVDLALPDGQALERGNAPLRKLLVDGLEILAQKSFVGHSTAGVAYAAKRTRKTKSP

SEQ ID NO: 7355 - protein, 1168 aa, unidentified
  REGION 1..1168: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLGVDPRGPVKSSRQRVRHLGAAFPREGVEAEVERILQAHKDILPGVDDPLIHALLRDHTARPVPGLRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGRAPDNLDRLLALPDAERALVLDPVRLYCHRDPLLSVLWPALPARLQRRLRGQWRRGRALTVADVLAACGDARPAAEAALAQYLEAEAAKKKRAPDPPRIPDTPAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYAGLGVRVGPGLIRKGRIAEDLGWTCPYTGQPYDALDLLHRRVDKDHIIPRSERASDSLDSLVITFAEVNKWKGQRTALRFIEEEQGKPVPGLPQLSLRTLAAYRQAVEKLECFKGHENDQRRKRNRKRRLLLRHYVEKDFTPADLTQTSQLVRLCAQALQRLGLGCARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANKNIPIPAPDAPTVLIISRKRNGADAAPAAGKVFHQTPAWRWVYEIKDKTALLGLAPEGDPAAAKLKRLKAVKVLGDNFGLALDPEPALIRPHKIWHQLAALRARNGGKPPRVLRKGTLIRVNQKSARSDYRGTWRVRGVQLNQRAGYLVDLSPPDQIHYVRQRGSFRNVSVATLLKCGLEILKTPLSGVAAPP

SEQ ID NO: 7356 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLVCAAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKGILPGVDDPLIHALLRDHTARPVPGPRLPARYGQRQPDGTLRPGGLLFGQLLPRFDNRIIARCPIAYERVYQQVLAETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLEAEAAKKKRAPDPPRIPDAPAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYADLGVRVGPGLIRKGRIAEDLGWTCPYTGQPYDALDLLHRRVDKDHIIPRSDRASDSLDSLVITFAEVNKWKGQRTALRFIEEEQGEPVPGLPQLSLRTLAAYRQAVEKLECSKGHENDQRRKRNRKRRLLLRHYVEKDFTPADLTQTSQLVRLCAQALQRLGLGCARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCEETVWRVFDPADPHPNARRLARWLANENIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRIGSLIRVNQKTGRSDYRGTWRVRGVHLNQRAGYLVNLSPPDQIRYVGQDGRFQNVSVATLLKCGLEILKTPLSGVAAPP

SEQ ID NO: 7357 - protein, 1191 aa, unidentified
  REGION 1..1191: note = Description of Unknown:uncultivated organism sequence
MSAKQNISSPHPDLHLAFDVGHSSIGWAVLQTPAAPSPEPAAELLGCGAVVFAPDDCLASTRRGFRRQRRHIRATRQRIARMRRLLAHLGVLTPAQLAAPGGAWPWLLAARVLGGGAPLTWPELWDVLRWYAHNRGYDANRAWSRQEKPDTEDSEKAQRAHELLREFKRRHGRPGTMAEVFCDHLLLREFERRHGRPGTLAEVVCDHLGVDPRGPVKSSRQRVRHLGAAFPREGVEAEVERILQAHKDILPGVDDPLIHALLRDHTARPVPGLRLPARYGQRQPDGTLRPGGLLFGQLLPRFDNRIIARCPIAYERVYQQVLTETGDREKARREAEKRAKVPAAHDADFHRFRWAMVLAQINIAVPGAPQPRNLSAPERNSLHAVMEQKGGLTKSELTQAVRQLTGGAPDNLDRLLALPDAERALVLDPVRLYCHRDPLLSVLWPALPARLQRRLRGQWRRGRALTVADVLAACGDARPAAEAALAQYLEAEAAKKKRAPDAPRTPAALAGRVLRVERARGRAPHTREIMREAVAFVLATDRHPAEEGGPLYRSDAIREAQLRRALDEQTNNHLIRHRLKLLAGDDAAGPRALNGLFRDLANTYAGGDLGRLGRITIEVNRDLRELSGKTAQEQAQLIGQQLANFKSVEKKLTEAYAGLGVRVDPGLIRKGRIAEDLGWTCPYTGQPYDALALLHRRVDKDHIIPRSERASDSLDSLVITFAEVNKWKGQRTALRFIEEEQGKPVPGLPQLSLRTLAAYRQAVEKLECFKGHENDQRRKRNRKRRLLLRHYVEKDFTPADLTQTSQLVRLCAQALQRLGLGCARPPVVTALPGAVTAAVRKAWNLTGCLAPANPLALNPDDLDDHGQPRPHNKTELRKITHLHHALDACVLALAAHHLPRDGEAWRLLLKRRLAPDEQRRARQLLGRVAAITPQGELRLNDLPPALKEQVSRRLRERRVVQHIPADLSGLRCDETVWRVFDPADPHPNARRLARWLANKNIPIPAPDAPTVLIISRKRNGADAAPAAGKVFHQTPTWRWVYKTKDKTALLGLAPEGDPAAAKLKRLKAVKVLGDNFGLALDPEPALIRPHKIWHQLAALRARNGGKPPRVLRKGTLIRVNQKSARSDYRGTWRVRGVQLNQRAGYLVDLSPPDQIHYVRQRGSFRNVSVATLLKCGLEILKTPLSGVAAPP

SEQ ID NO: 7358 - protein, 1075 aa, unidentified
  REGION 1..1075: note = Description of Unknown:uncultivated organism sequence
MKDKQKNTLSQTADLELAFDVGHSSIGWAVLQSVSPAPAQTETPSVNLLGCGVVTFGANDCLASHRRAFRRQRRHIRSTRQRIARIKILLKQLGVLDEATLNQPGCAWPWRLAAQVLQGGKRLTWAELWDVLRWYAHNRGYDANRRWSAAEAQAQQEDSEKEANARTLMDKHRTKSMAETFCRELGIDLSGKKKSSTKRFKGLKAAFPREIVENEVRKILQAHHDILPGVDGRLEEALFTNWQAIPCPNLKLPNRFQGGLLFGQLVPRFDNRIISQCPISGQKVPSRNSNEFLNFRWAMQLANVRIARFGELKLSPLSPGERRELDQQMRRVGAMTAEQFKKTVRNVSNAIQDNLDTMLMHPDAKEALTLDPVQKLVRSTELAPFWELLPERLQSRLRGQWRRGKVFSLAQIRTQLAGYGDVAAFDTAVQKQLEARHVKSRKKDKPLTREDLLERQFPPQPIKLAGRAAFARPLLQQAYAEVMDGQHPKEPGGCLFLSEEIRQRQLAREIAAQTNNHLVRHRLLILERLLNGIINEYAGKDKTRIGKITIEVNRDLREMSGKTAKEKAQDLGLRIANHHAVAAKLEKAFAEENTRIPITAGLIRKARIAEDLGWKCPYTGQDYEPRQLVSRYVDKDHIVPRSHRASDALDSLVITFSAINKWKSNRTAWEFVEQEQSKPVPDLPHLSIMSLSRYRQFVESLETYKGHDDDKKRKKRRKELLLLPKYEDKEFTPRDLTQTSQLVRLGAQVLKRAFAGHEQPPIVVSLPGSVTAAVRKAWKILGCLSLANPQVLDENGEVKNKTDIRGITHLHHALDACALGLASHFIPNHGRVWELIVKRTVNDAEKEELMALGIFTFSANHRFEMRDLDNRLKEQIRQRLAEKRVVQHVPARMGGLRVEQNTWRVVEVKAGKARIQQRIRQADESRPLKQTEEKTSKLLGLQPGKLSVNKGVLIIPDNYGVALDPEPTIIPFHKVWERLRELKKADGGKRPRVLRNGQLVKVPQGKFMGIWRVFSVKNNTSGIAVDLGFPDVVRLKNKMAGHKINVLLASLLKNGMRVVKPPLTGVPTWPTTSSA

SEQ ID NO: 7359 - protein, 1116 aa, unidentified
  REGION 1..1116: note = Description of Unknown:uncultivated organism sequence
MDKVIWRLGIDAGEKSVGLAAVQYSTNGEPEKILSAVSYIHDGGKDPDGQSSQSRKATAGIARRTRRLRQRRRQRLEELAGVLGELGCIVPKNNQPQTYEAWVARAWLVRGYIHDDLERRRLLGLAIMHMGHFRGWRNPWWSISKLSSLPVPSKNLETMAQVSSDKLGVPIESLRTIGELGALSQISPGLPLRPRQKKKGSQQPASVKGPDNTTAIPKIFFEQIRQEDILHELRLICETQLLDREFFEKVSEVLFKQNKPTVPEELVGRDPFDNSPRALRASLEFQEFRIRDKVANLRILRHGEKERLSPELHEQMVQYLLDWREDPPTWHEVAEHFGIGERSLSVEDTGDGVTPTKAPIDQSSCLIEKSQKLKTVNDWWKEADFSARSSLITYLADSVEVELPPVVLELFENLSDDEYIELEQLKFLSGRSSYGRDSLTRMNEVMKSNVCDLYQARTIAFNKDQYWMPPKATFAQITYQPAVDRNLAIVRRFLMASVEKWGSPDKVVIEHVREAFLGTEAINSLNLELSIRRKENDKIRDELKLQGIAEPHRSDILRRKLLQQQNSQCLYCGDTLDWESVELDHIVARASGGSSRISNLAAVCRQCNSEKGKRPFGLFASQTQRSEVSLEGAIKRVKEWHKVGNQLSNMQFRKYQADVIRRLKRISDDEPLDERSMNSTAYAAQAIRERIEQYLEPQPDFKITDRGQAVQVYNGRITDLARAASGLGPKLKLRGETSKTRLDRRHHAIDAIILTSLSPAVARVLIQRDDMRNSEMIRQGGHSSFKKYSGRSIGDQVIFARWLSTSAGLSDLIVGTVSKDEIPVVNPIRLRPEIGALHKDTVQSLVTKRLGDSFTVEETRRVIDRKIYLSLLDELNGRGILPADQSRTASSEGLIVLTADDPIQLFPASAAMLPVQEGAVELGAIHHARVYAWKTPKGKIAYGMVRVFGGEFGRIGFRKKRVNVFTKELPIWSESWRLAEPRVTAFISNGAAKQIGWLTIGDELDFGDPDKVPGNGAIQEFLKEFPETRWQIDGFESPSTLRLRPLYLAKEGLPEVSNKAIKTIVDLPGWRPSINVALSANSLSTIRRTALGRPRWESTSLPISWSPFQKANQALL

SEQ ID NO: 7360 - protein, 1236 aa, unidentified
  REGION 1..1236: note = Description of Unknown:uncultivated organism sequence
MGRYTNRKRWFVGVDVGQCSLGICAVEVDGDDTPISILSIVSWIHDGGKDNSTGETPRSRKVIAGVNRREQNREAHRNQRLMQLRSELQSLGIPYPDEDNDSARLEPWEDRALLVAGRIEDESEMNIRLGRAITHIAKNRGWRNPWWSVDRVSKLTVPSSSFCKIRDRAVKQFGDSAKDLRTLGQIGYLSVKQAGQIGSKEKSRFRPLLDSTTGKFTDAGIVQENIRQEDLIAEVKLICETQGLSDDVCEKLCSAIFYQVHPYVKAGNVGRDPFFSDQLRAPKATLEFQEFRIRDKVANLRVQGRNVENNKLPKEKRDEIVDLLLHWDGDKPPTWEEVSDMCGLPSNQRLKTDSVDKSNSHSAPIDDTSRLMRTSGLVDEWNKLPKDEQADFIASWVDTVPLDEDIDPDQDIVSLVMDRLTDSQQDEMERISFQGDRAAYSRETLQRLNEIMAETGCDQTTARWDAFKDVMGWQDEEEARRWTPPKNTFYEATENPTVDINIGLVRRYLQTATAKWGPPERVVIEHSRNGFMSPQKVQEEIVIQSARRDDNDIWRQKLTDDGLTVSDSNIRRYKLLERQNGACLYCGTEVTFTESEIDHIVCRSTGGSNRESNLVLVCPGCNRSKTNKTFSLWVKNNDRRATLEATIERVNAWTDVGMENVTKKINKQRAAQRAKKGEKVAQGEKKGEKVAQREEQISLFANLKKDVIKRLKRTDEDDLIDERSMESTAWAAVAVRERVEDFLEKQVKSYPDYDPKGVVHVYNGRITSLAREYSGFSKTVALRGQEKKIRWDRRHHALDALIVTSLRPSVAKTLAEKGDMKDADSLRSSPTKKHVEYEGSSDGDRVLYGQWMTNVKKLAGLAKDALEHDRIPVSYVSRTSPYYEPKHKVRGSKLIKRKLGDSFSSDEVRRVADKHFYMALLKHLEYDEKNGFKTNPGRTLVLSDGRTLGGNSVIGLYPASKSGRKPKDPSIDPNAPKVGKAAMLSVKRGASELSYVHHARVYAWETTSNSKKEEPEYSFGIVRVFAGEFPRMGFLKDGADVFTKALPEWSESYRLSDETVLSKLKSGEAKQIGWLLAGDELEFGSGFLSQIKGNNSIKAFTSTYPADNRWVVSGMPLTSSLTLSPSYLSQETLVKKSKKSSSKTTVSTTETLTRDTSDESAGDDVDDSTKTDPALKVVESGWDVKMKKIFADPDLKIIRRSILGVPRWHDTWNQEREKERLPKSWQPHLEAKRLLG

SEQ ID NO: 7361 - protein, 1095 aa, unidentified
  REGION 1..1095: note = Description of Unknown:uncultivated organism sequence
MNIRIGIDVGERSLGLAAVEYDDDDGPIRILAAVSHIHDGGMDPDTSKSPKSRLATAGVARRARRLTRNRRKRLLMLNEVLNKYGYPVPASEVPQTHEAWKARARLVETYVKDAKERDRLIVLATRHMAHHRGWRNPWWSYQRLTESTSPTEQLTNTLAAAEARFGSQVNAAMTLGQLVSKVAAAGMPIRHTKAADTNPVGALLIDQVRQEDSLAELQLILKTQKVDPEAMNAICAAVFFQSKPTIPKDRIGKCDLQPDQIRAPIATLEFQEYRVRAAVGNLRIGREKRRLTEVEHDQAIDFLLTWRDEMRPRWRDLAEELEVAPRDLTDPSLDGQGGSNAPYDRTSSIVESKFKKTTKVGAWWLGASEVEHGELIDTICDLSGEDQEYATDSVADLLSLDDVLEDLNKLNDALETGRASYSRDTLRRLNAQMRDNRTDVHEARKAEFNVPDDWSPKRPSLDDPIEHPTVARVNALVRRFLTTAVQKWGMPDRIVIEHVREAFAGPTGLAEIKSEIRSNTWKREKTAELLKAQGIDHPNNSSIKRNECVERQNCICLYCGTTITLLNCELDHIVPRTGGGGSRRDNLVAVCRACNKSKGKMPFAVFAEHSKNPEIAVPAAQERVRNWQRSGMTNKSFRMLQSDVKKRLAMSADDEDFGDRSIESTAYAAREMRARIENFLDQQAARLQVERGQVVVFSGIVTSEARKAGGIDDMIRLRNFTRKSRFDRRHHAIDATVLTSMRLGVAKTLKDRANLHRDNRYTGKDPEWKEYRGASQGEQEAFTRWQNRMEGLGELIKAAIENDAIPVVRPLRLSPRVGSVHADTVEPLVRKEIGEAFTKDEILRIVDRSLFLRMSSLAGDGDLDTDPQRSAELRWAPDRSVDLFPSNAAYLAVRHGAVAIGGTVKYARVYAWRTKTGFDYGMVRMYVGEFPKIGFSGPGVDIFTAPLPPYSQAIRTANPRLRKRIESGEARQIGWVATDDELELAPSEFAIGDTKMALFMQQLPESRWLITGFFNTTKFSIAPSYLASEGIDESTAESVASVVKANRIPLGVNVVLASANCTIIRRTVTGAPRWHGDGLPRSWNVREAAEQAFSS

SEQ ID NO: 7362 - protein, 1107 aa, unidentified
  REGION 1..1107: note = Description of Unknown:uncultivated organism sequence
MPICIGIDVGERSVGFATVEYDDDGWPIEILNSVVHIHDGGMDPSTGKAPQSRLATAGIARRTRRLIRNKRKRLQLLDHILQQHGFPVPIDELPQTHEAWRARAQLINNLVPHPADRGELVSLAVRHVARHRGWRNPWWSVERLAQAPTPTDSFVQTLDMAETNYPGKAKNSRTMGELVSRIVGTGAPIRPTSKSLGNTVGALMATQVRQEDSLFELRLIFETQQVPDNVADSICAAVFFQTKPHIPRDRIGRCALQPDQLRAPLASLEFQQFRIRDAAANLRVGREKRRLTESEYDIVVEMLTHWRDDIRPRWRDIAEKLDISARDLVDSSLDGSGGTYAPSDRTSTAVEVKFKRNSTVGAWWTTASAAERSELISIITDLSSEDGDIFSDSLQEFLSQETVLDPLAGLNEALESGRAAYSQETLNKLNSIMRETRCDLHTARKVAFGVDDSWRPPLPNFNDSIEHPTVARVNTLVRRYLMNVVDKWGMPDRVIVEHVRGGFLGPSALAELKNEIRLNTFRRDGVANLLRVQGIEHPSRTEIKRNECVERQNCVCVYCGSTITLLTCELDHIVPRASGGSSRLDNLVAVCRSCNAAKGKQPFAVFANHAPNEAISVHEAQLRVKAWQRVGMTSKSFTRLKANVSQRLSLSADDETDERSLESTAYAAREMRARIETFLVEQGKRHEVSAGQVLVFSGAATSEARKAGGIDDRIRLRTMTRKSRFDRRHHAIDAVVLTSLNLAVARTLKERSWLQRDNQFTGKEPGWKEYRGTSAKDQSAFNAWRERIGALAELLEATIRLDNIPVVRQLRLAPRVGSVHADTVQPLAYKSIGDAFSQDEVLRLLDRSLYMRLQEIAEGGDLEFDERRSELQRWASERPVALFPTSAAYLPVRGGAVTIGGTIRFAQIYAWKTKDGFNFGMVRLYVGEFPRIGFGGPGNDFLTTTPPAHSQAMRTANSALRQRIQSGDARLIGWIAVDDEIEIEPTYFQTDGTKLGEFLTLFPEKHWLITGIAEPGKIGIAPSYLAYEGVVTAADMERGGARSEHETPAAVSEVLKANRIPMSVNVILGSPGCNVLRRTVLGRPRWTGDSLPTSWNVLAAAEEAFEK

SEQ ID NO: 7363 - protein, 1116 aa, unidentified
  REGION 1..1116: note = Description of Unknown:uncultivated organism sequence
MVLGGAVHVGVDVGENSLGLAAIEKDGDGFPVAVPHLLVVLHDGGKDGMASNQTSSVSRKASGGMARRVRRLFRNRRRRRLALERLLAEIGFPTESYGDSTYEPWEARIALLKDRVEDDRERRRLLSIAIRHMANHRGWANAWVSIDSYVWKEEPSKEFERAVAAAAESDSLGTVDPRSLRYQADLAALALDHRTLIRQRGGRDNLLGVQRRVDVVREWRQICRVQGVDDGTFLSLARVAFGQEKPKVPIERVGNDWLPGYTNRKRAIVASMEHQEFKIRQAVANLAVRESARSNQRSRLSPEDQRLIADQLLGEVDKDKAPSWKDVAEWVGVAPHLLVHASPEEQLTGRAPINTTVVAIHSLPKKHPVLAWWQGADAELRSEFVRWFADPAAIEIRSESEAAFEQIFESLDEKELEAAQKLRFSSGRSGHSIEALRRINAEIEASGDTYVQVRNRLFGGGEDIRPKDLASLDTQADHPTLQRILPPLRRFLFALKRRHGEYPEQVVIEHVREAFLGFEAKREAALRMLRNRRDRELAQQDIANAGLGLVNASDADLRRFQAIRRQNSACLYCGATPGWSGFELDHIVPRASGGNSTQANLVAVCRLCNAAKGKRPFAVFAQSGDRPVVSIDDALRRVEEMDRGRIDARQFWRLKQEMKRRLKQTEEDEAIDERALASTAYAAVDMRERIQMSLGLGPERVPVYSGRIVSMARHASGIDKAITIREGIDTKSRFDRRHHAIDAAVAAMLNPSVARTLAERDDLRRESKLTGVDNGWREYEGSSPRAIERFRQWKTAMIRLAELVDEKLRADEVVVMQPVRFSGRHSKLHEDGRAPHARRRLGAAWTSVDRARIVDDRVYEALSAGLQAGDPLPEDDARTLRLPSGRMLTADDEIFIFPDGSARHPLPNASSAPLGGSVHHARLFRWPGKGGAWNAGIVRVFASDLYDLEGGVEGPILSAPLLARSRAVRRSQLPVREAIERGIAEQVGSFVIGDEIEIVPSEWGTSGKAGEFFARFPERRWRLTGWEQEGVLNLRPMYLALEGATLASDDEEPDSRLVRISRTEEDIIKRTLRVAPSWLWKTPSTRVVRRTALGEPREATTGVPMSWSPHRAVFGD

SEQ ID NO: 7364 - protein, 1127 aa, unidentified
  REGION 1..1127: note = Description of Unknown:uncultivated organism sequence
MMAAPLVGIDVGENSVGLASIECDDSGMPQRIGRLLVVIHDSGKDVMASGQTASVSRKASGGAARRVRRLLRNRRKRANRLADELSSRGYPLVDASELETYAEWRARSRLLRDYVTDDAERRRLISIAIRHMSNHRGWANAWVSLDSYVWKEEPSAEFEAAVAAAVAEDRFGELDPDRLKFQADLAELGLSTSERLRPRNPAKPSEHAVRTAHLLGQQRRVDVVREWRQICRVQRVPDEEFLALARIAFAQEKPKVPLENVGFDWLPGYQQHRRASIASLEHQEFQIRQTVANLAVRGRPGPHGRGPLTVDEQNVIIDHLMGVTKADEAPTWKEIAELFLGVPPTHLVSSEPDESLHATAPILRSAAVIHQLPKSHPVMLWWRAAPDVRRADFIRWLADPAKIEVPDEGEFEQLLDELSESETEALLKLKFPSGRSAHSVESLRLMSAEMQRTGDRYVTVRNRLFNAGEDLRPRDLQSLDTESDHPTLQRILPAVRRFLRSVEHGPAGPPRQVTIEHVRSAFLGFNARQELISEQRKNQRARQRAQEEIAAAGLGISHASDGMIRKFQAIQRQGSRCLYCGATLVWSSTEMDHIVPRKSGGNSTRANLVAVCRDCNAAKGKDPFAVFAQSGRRPGVSIDDAIERVRSLERGELDPKSFRRLKGEMIRRLKQTEEDEPIDERSLASTAYAAVDMVRRINTHYGDEGGDRAKVYSGRIVSMARHASGIDRKIRIRDGLDAKSRLDRRHHAIDAAVAALLNPSVARTLAEREDMRQSARNGDGDDRWKTYKGSSPAAVERFERWMAAMDRLAVLIREALDRDEVVVMQPVRFSAHHAALHEDGRAPHQTKRVGDAWTSAERALIVDDRVYEAISGGALPSADLPEDSNRSIRLPNGRRLDAEGKVFIFPDTAARLPLPNQSSARLGQSIHHARLYRWRDARGRVAGGVIRVWAADLYDLDGGVRADLLTAALRPSSRAVRRAKNVKLRDALVQGIAEHVGTFVVGDEILIDPAEWAGDNEPGRFLAEWPERHWRLAGLMSDSQFTMTPMYLSQEGVVREEEFDPDEHRRIVPVSADAFKVISDRLRISASSLWSTESTRVIRRTGSGAVREAPDRGLPASWSPYLAVHGS

SEQ ID NO: 7365 - protein, 1135 aa, unidentified
  REGION 1..1135: note = Description of Unknown:uncultivated organism sequence
MGGRPTRYVIGIDVGQSGIGKVAIRVDSDGMPVEILNANVTVIDAGKDPASGKTPKSRLATAGQARRVRRRFRRRRQRLKRLARYLAQLGYLPPDKSRTYDAWLARRDLAMRYEPDEAKRAERLALAIMHIARHRGWRSPWWSYRRLETAPAPTPTFAELQQRAAAVFGRPVEDFPTIGAIGAAAASPRFALRLRSRGGSLAAQNPHLVLFHKKILQEDVLSELKRILSTQRVDPGVARTVCEMVFDVSKPYTRGESVGRDPIPKHSNLQRAPRSSLEFQELRIRQVVANVRVRGEGGKRRLTREENERLVTWLMDRIEAPSWAEVAQFLGLEPEQLTHEAVDDPVGNRAPILATKAAIERGAKDWPHVYNWWTRQATQEERSLFACFLGDTTDTGDYSAIEAYLEEFPEDELVKLMEAASVPKGRAAYSRATMRELCEYMAEHRVDLHGALTGLYGLPAGWKPPAPSIFERLEYPHPTVDQITRDVARWLQAMVSKYGTPERVTVEHVREAFMGVAQRAEYQAQMRRRQRDRERIRAELVQQGYANPTEQDIRRFRLVTMQNGECLYCGEPITLATSELDHIVPRSVGGSNRSENVVAVCKRCNQAKGKNVFSQWAAATDYASVEEALARVDRWARPRDFDAASFNRLKRDVKNRLRRKSEDDPIDERSLASTAYAAREIAQRIQAYLGSLDRPVDPHSGEVLDVKVQVLSGGVVSEARKASGIDKKVRLRGFGHKTRLDRRHHAIDAAVAATLRLTVGKVLVERRELRDMTSAVATPEERDAWKAYEGSNPMEVEQFRRWKARSGRVAELMERAIAEDRVTVRYPLRLGPNVGSVHDDTIFPLHKKPAREAFTPNEVLAIADPELYIAALPLLDKRGGLPKLAEREPTGTVLDDPDGVVELFPSWDKSDITPYLRVRGGAAKIGSTVHHARLYAVPSKRGPKLYQMRVFAGEFASIGFKKAGVDLFTAELPVWSQSYRAAPRALRDALEAGTAVYLGWLAPDDELEIPAEALHLVPCLAPPGDAVHGAFPLRGALREARWRVSGFEATELVNLKPALLATEEFSQADLQALTSFPGGKPYFGAQGWRLSVSKLLELRPTVVRRTASGAPRWRSEGSLPTSWRLEDVLAGVIAP

SEQ ID NO: 7366 - protein, 1135 aa, unidentified
  REGION 1..1135: note = Description of Unknown:uncultivated organism sequence
MGGRPTRYVIGIDVGQSGIGKVAIRVDSDGMPVEILNANVTVIDAGKDPASGKTPKSRLATAGQARRVRRRFRRRRQRLKRLARYLAQLGYLPPDKSRTYDAWLARRDLAMRYEPDEAKRAERLALAIMHIARHRGWRSPWWSYRRLETAPAPTPTFAELQQRAAAVFGRPVEDFPTIGAIGAAAASPRFALRLRSRGGSLAAQNPHLVLFHKKILQEDVLYELKRILSTQRVDPGVARTVCEMVFDVSKPYTRGESVGRDPIPKHSNLQRAPRSSLEFQELRIRQVVANVRVRGEGGKRRLTREENERLVTWLMDRIEAPSWAEVAQFLGLEPEQLTHEAVDDPVGNRAPILATKAAIERGAKDWPHVYNWWTRQATQEERSLFASFLGDTTDTGDYSAIEAYLEEFPEDELVKLMETASVPKGRAAYSRATMRELCEYMAEHRVDLHGALTGLYGLPAGWKPPAPSIFERLEYPHPTVDQITRDVARWLQAMVSKYGTPERVTVEHVREAFMGVAQRAEYQAQMRRRQRDRERIRAELVQQGYANPTEQDIRRFRLVTMQNGECLYCGEPITLATSELDHIVPRSVGGSNRSENVVAVCKRCNQAKGKNVFSQWAAATDYASVEEALARVDRWDRPRDFDAASFNRLKRDVKNRLRRKSEDDPIDERSLASTAYAAREIAQRIQAYLGSLDRPVDPHSGEVLDVKVQVLSGGVVSEARKASGIDKKVRLRGFGHKTRLDRRHHAIDAAVAATLRLTVGKVLVERRELRDMTSAVATPEERDAWKAYEGSNPMEVEQFRRWKARSGRVAELMERAIAEDRVTVRYPLRLGPNVGSVHDDTIFPLHKKPAREAFTPNEVLAIADPELYIAALPLLDKRGGLPKLAEREPTGTVLDDPDGVVELFPSWDKSDITPYLRVRGGAAKIGSTVHHARLYAVPSKRGPKLYQMRVFAGEFASIGFKKAGVDLFTAELPVWSQSYRAAPRALRDALEAGTAVCLGWLVPDDELEFPLEVLHLVPSLTPPAQSEGQAYPLRETICERRWRVSGFEDADRLNLKPVLLASEEFRHAELHALADAPGGKAYFGMQGWRLSVSKLVELRPTVIRRTASGTPRWRSEGSLPTSWRLEDVLAVVTAP

SEQ ID NO: 7367 - protein, 1124 aa, unidentified
  REGION 1..1124: note = Description of Unknown:uncultivated organism sequence
MKYLVGIDVGESGIGKVAIEVDHRGNPVRILSAVVTIIDGGKSPDSGKSPRSRKKLGGIARRARRLVRRRAHRIRELGCLLDDLGIVDPNGLHANGVTYEPWHARVGLSSAYEPNDAKRFADLRLVIQHIAHHRGWRNPWWHFERLALEFKEDSSPTAEFEVVRERAAKLLGLSPDELTTVGQIGWAASNPKFALRPRHLDMSTQAAKNRQTSDNIIVDRLMQQDLLRELTQILHTQQISSPESDKICSLVFKAAKASVPSENVGKDPFSKTELRAPKSSLEFQEFRIRDTIANLRIASTKSPLSEEQRQMVVARLLTWEEGAAPTWADVSDWLGLLEQDLKFASSDTARASKAPINVTHNKIVRLSEVGDKQKRLAGQHIQKWYADATPRVQREFCAFLGDSTDAGNDDELEALMEHLGEEEFAILDSLDQLSGRAAYSRGTLARLNSAMATGLDLNGALMKEFHQVSGWKPLAEPIFAQVDHPVVDRVMTDVGRWLDAITTKHGAPERVNVEHVRSAFLGPEAKEEYNSETNRRRKQNEADTKAISEELNIDVKTTDPRRYRAIQMQGCACLYCGEVIGYTTCEMDHIVPRAVGGSNRRDNLVAVCQRCNRSKNAEPFANWAADVDFVSIEDSVERVKMWQRPQGTRALEFGRFKKQVTFRLKRTELDDEIDERSLASTAYAAVTVRERVQGFLELKFANPASGEVGQIPVNVYRGALTAASRKAAGIDRRIKLLGFDAETHAPGKSRFDRRHHAVDAATVAMISPGIAQTMGQRVELRGFDRPGTSSQVPSWKRYEGKSSETFESWVSMVQNMADLLNTEIERDRIVVMRPLRLGANVGKIHDDTVQALVRKNLREGLSAQEVNRIADRDVWRVVRNLTTGAGDLPEKVNDPTLAKLLTDETVGLFPKKSAMLAVRNGAVAIGSTLHHVRVYRRDDGPGKPAKFSQIRVFAGEFGTLGWRKKGVNLFTEPLPNWSEAIRCGDLKLQQEIENGSASLIGWLVPGDEIEFAPGDAILPVIEPIEGVTSSPLTENRWVITGFESDSTINLAPAYLAREGIKDQDSVPPVLDGKFWRAAINKVMRARPTIIRRSATGIPRWHDLRDGLPISWKVLPDSSPALEPR

SEQ ID NO: 7368 - protein, 1104 aa, unidentified
  REGION 1..1104: note = Description of Unknown:uncultivated organism sequence
MSKGIEVQMRYRIGVDVGDRSIGLAAIEYDEAGSPIRILAAVSHIHDGGMDPETAKSPLSRTATSGVARRTRRLVRNRRRRLARLDQLLLTHGYVVPEEEIGQTHDAWSARARLSKEYELNDKTRINDLSLCIRHIARHRGWRNPWWKWSTLRDSEGPTDKFVSMQASAAERFGPEMLTCDTLGQLVIQIASSGVPVRATKQATARGVDPLMSNQIMQVDSLFELRTILVMQKVPTDVIDLICAEVFSQEAPHIPKDRIGSCALIPSEVRAPIATLEFQEYRIRAAVANLRIGRRERLRLSEQMHDTVVEFLMNWRDDDRPKWSDVSDYLSVEARDLIKPSIDEEGGTNAPHDRTRSGVEKQLKKKTPLREWWDSAIFVDQAEFVDFLTDLSGQDFEPSSNVLAELISDDAHVETLEKITMAESGRAAYSRIALQKLNDVMREKHCDVHVARKIAFDVADDWQPPKPTFNDIVGHPTVDRVNVVARRFLSTSMMKWGEPEIVAIEHVRTAFMGPTGRAALLQEIGFNTRKRDKQKAELVSQGIQNASNVDVRRLECITLQNGMCLYCGTALTMMSCELDHIVPRASGGSNRRDNLVAVCRECNKEKGRDPFPVFAARTHRNGVSVEEAKLRVRAFSKGSLTVLQLKRLQRDISKRLSLETDDEEGMDRSIESTAYAARELRKRIESLLGITGTSISDPGKARVVVYQGIVTSEARKAGEVDGILRLRSFTKKSRLDRRHHAIDAAVLTTLSIGVAKTLKDRAELASSDRFTGHDPGWKEYIGRNGQEMKQFTEWKKHIGALAKLLKGSVENDKVHVVRQLRLVPRVGAVHADTVQKLVHKNIGKEFSSAEIDRVASYSLFDKLSHLADDSGNLPEDSARHLALKLPADFEVDLFPSSAACLAVRGGAVEIGGSIKSARVYAWKTNSGFGFGMVRVYTAEFPKIGFLKSGIDIFTAPLPANSQAMRHASAGLHRRIESGEAKQIGWIAINDEIEIKVTSFNEGEEKLPKFLQACPENRWVIKGFFSSVQISIVPSYLAAEGIDDGVPEVVQQTLREGRIPTAVNVLLSDPDTTIIRRSVLGTVRWRHDGTSSSWNPHQAAKKIFG

SEQ ID NO: 7369 - protein, 1132 aa, unidentified
  REGION 1..1132: note = Description of Unknown:uncultivated organism sequence
MSAPLNYRLGFDVGERSVGFAAVEYDDQGYPLKFLAIGSYLHDGGMDPTTNKNPKSRKETRGVARRTMRMRRQKIKRLKKTDKVLRELGYQVSHYTDEPQTYEAWYSRRLLATQKLSSEELNDHMVRAVRHMARHRGWRNPWWSLTQLESASAEPSETFVQMFEKAQERWADELILPIEETTLGMLGALSDDNKVLLRPRTYDSKKEKHKEKLNVKGEEPVFFAKVRQEDILRELRIICVRQGVESQYEELRKALFDQIRPHVPQENVGRDPLDPSQYRALRASLEFQRYRILDALANLGVREGRGKPRSLTGEERTQAWKFLSTYRDQKNAPTWGDVAEAMGVEPALLVAPVIDEVRLNKAPYFSSLVAVEKKLKKKHQIYKWWVEASVESRGLLIRVLADATNATLDEASEAGLLELIEGLPEEEREVLDGLSFETGRAAYSADTLTKLADYMEEHLAEGIGVHEARKAVFGVDDSWQPPKATLEEATGQPTVDRVLTIVRRVVLSAQRQWGDPAEIMVEYARTGLMGPAQLAEVKREIAKNRKERDRIRQDLKDGGVSEPKKRHIMAHRIVQDQNCQCMYCGAMITAASCELDHIVPRAAGGSSRRENLAGVCRDCNASKGGRMFADWAADNPRGVSLKDTLGRLRSWEPFKKADKKRLLKLIERRLKQSVMSPEQIDERSLAPTAYAATAIRERLRRHFEDDAKPIPRKDVVKAYAGGLTRESRRAGLIDEKLLLRGSRDKSRLDVRHHAIDAAVLTMLNVPVARTLEERRLMKRERDLSARDNDWRDYTGTAEDKPKFVQWKQAAGEMADLLIDAVDQDSIAVINPLRLRPQNGAVHDDTIRPLEERALGAEWDPATIKRVVDPSIYLALVDALGKSKSLPADSQRELVLDDGTLMSADDSIALFSTNAASILTPRGAAEIGGSVHHVRLYAWRDRKGEIEVGMQRVFGAEFPWLMRESGVKDVFKVPVHRGSQSYRDLQDGVRKQIESGAAVEIGWITQGDEIQLNLDEVRDSMRSKELLTFLEIFPETRWRVDGLPDNRRLRMRPVLLASEGIEEFLKNAPEDIQTIVVNFFKNGALLSVSKVLALTETKIIRYNHLGFPRWRGVGRPVSLDIQRAAREALEGKK

SEQ ID NO: 7370 - protein, 1132 aa, unidentified
  REGION 1..1132: note = Description of Unknown:uncultivated organism sequence
MSQEATKYRIGIDVGDRSVGLAAFEFDDAGFPLRKLAMVTYRHDGGLDPTQNKSPKSRKETAGVARRVRRLRKRRKERLKKLDLKLLELGYPLPEGEEAQTYQAWKSRALLTSQKIEDKAEQAEHLVRALRHMARHRGWRNPWWQFGQLDSAPVPSETMVENLNHARLLWPGYITDQTTVGELGALAASPDILLRPRTRDIKKKPNGLHHQEGVRAVLGSKVRQEDLLAEVKKIWQVQELPVSHYEELARALFEQVRPYVPAQNVGRDPLPGRHHLPRAPRASLEFTEFRIRQAVANLRVREGREKVPLTSGQHIAAVNYLMNYADKQPPTWGDVAEQIGVEPTRLVAPVIDDVRLNKAPYNHSTSVFTRALPKKSEAMQWWNSADVSLRSLLIIFLSDPTEEATAAADESGLSAIFESWPEKEREKLEGLDFESGRAAYSIQSLIDLNQYMEEHQSDLHTARKEVFGVDDSWQPPRENLHEPTGQPAVDRVLTIVRRFVMACERKWGKPDRIVIEHARTALMGPTQRHEVLREIQRNRDANERIREELRADGLTSPTRADVRRHRVVQNQDCKCLYCGTMITTATAELDHIVPRAGGGSSKIDNLVAVCRGCNADKGRIPFAVWAEQTSREGVSLDDALNRLWSFDKVVYKGVAGRKLKAQIARRLRQAEEDEPIDERSLESTAYSAVAIRHRLETYFNTSRGLNRGDDGFTFIDVYAGALTREARRAGGIDEQILLRGQRDKNRFDVRHHAVDAAVMTVLDHSVARTLAQRNLIYREDRLKRRENQDDTRWREFTGLGGEAQEKFLVWKQKSYVLADLLAEAIAEDSIPVINPLRLTPRNGSVHKDTLSSLDKMYLGGSWSSKDIARVVDPDIYLALMELLGRATTLDEDPQRSLTVKGKVLQADQEIKLFPESAASILAGTGAVKIGDSLHHARLYAWPTKKGHEIGMLRVFGAEFPWLFKTYGTKNALTVPIHPGSQSYRDMKDTLRKKIESGEAREIGWITQGDEIEIKIESYLQENDELGRFINLIPENRWKIDGFNDNGRLRLRPILLSYEEIPESYGEDVLGAKNHQLIRKVLERGAIITAGKILGAEGTKVLRRNHLGAPVWQGQQEARSLDISRAITEKLEG

SEQ ID NO: 7371 - protein, 1138 aa, unidentified
  REGION 1..1138: note = Description of Unknown:uncultivated organism sequence
MSMISTNDDRVEGMHMARYGERKYRVGIDVGDRSVGLAFIEFDEQDMPSELLRMFTVRHDGGIDPTTNKTPKSRKETAGVARRVRKMRKRRTKRLQELDALLMASGFPIVDVSVGETYECWQARAAAVEGFITDEQTRLETVSRAIRHMARHRGWRNPWLTWQGFRELEVPTANHRKNIESANSKLHLDLEDTSTLGQIAASASASNWMLRPRNGQKRKEASNPVLVAQVQQADQLAELYKILEVQRIDSTITEKIARAVFDQVRPYVPKGNIGLDELPGMGAYYRASKASLAFQEFRVRAAVANLRVKNSPRGQERLRLDPQDAQAVAEYLLTWREDQPPQWGDVANALSIDENLLVIPVFEDAFLKLAPYDRTSSDLEQRLSSSANKKKLAGVREWWDSADTQMRELFIEFITSPNESVYEEADESGFSDVFNGWSDEAKEVLLGMQFESGRSAYSVESLRRLNLRLRTGEVDLHEARRLEFGVDDTWRPSLPSIDERTGQPAVDRVLTIVRRAIMGAVDKWGVPEAVVVEHARSGFMGASARNDYLNEVSRRTATRAKLREIVKQQGVERPSDGDIHKWECINRQRCTCAYCGNEITFTTAEMDHIVPRAGGGSNVRENLVAVCRRCNSEKRNIPFAIFAESDAHPYTSLNETLTRVRNWDWSRDRSEQRLKNRMLQRLKRRESDPEIDERSLASTAYAAVEVRQRIAEYLGRITGEDELNRVQVYTGGATREARRAGKIDARIRIRGKDEKDRFDVRHHAIDAAVMATLNHSVAFTLRERAEMKRSATMNRYLDPNEEWKDYSGRTSSAQKRFTVWRQQAHRLADLIVDAVEADSVPVAQQLRLSASRGSVHKDTVSALVRKQLGAPWTAQEILQIVDPEIYVHLRDLAAQNKGVLELDPSRRIQLLSGVWISGSELVEVFPKAAASMKVSSGSVEIGEQIHHARVYAWRGTKGEFQYGILRVFTAELPWLQRQAQSKDLFTMNIDDRSMSYRDLLQTVRKKIESDEARCIGWLTQNDELVLNVEVLRQGSDKIAHFLSTYPESRWKLDGFPENRRFRIRPLYLSREGSDHLDPICAEILEKGAIVGTSNLLSNVHQIIRRDSLGFERWRSQGGLPASWSVPDSTADTVETGLK

SEQ ID NO: 7372 - protein, 1110 aa, unidentified
  REGION 1..1110: note = Description of Unknown:uncultivated organism sequence
MAQRRYRVGIDVGDRSVGAALVAFDDDGIPERVLHAVSYRHDGGIDPTTNKTPQSRKHTAGVARRVRRMRARRTKRLAALDRALIELGLPVRDVSDGETYEPWRMRARCVEGFIEDDAERRDAVSRALRHIARHRGWRNPWHSVRRERLESVPTATHQKNVAAAQAVFPGEIAADATVGQLGEVASRFNHMIRPRTGKKNPKQKTAVLNERVMQADQMAEVVAIWTTQRMPEAELNAVLELVFGQERPVVKAENIGRDELPGMGHLPRAPKASFEFQEFRIRATAATIGVRARQGSSKAERLDADAVDAVSHWLLEWDADDDPTWADVAVEALNLDPRFIKAPVFDDVRRMTAPVNRTARILRKALKKRHNAPVRTWWESASAESRAALVAFLVDPTDENEDLLDRTGLSDVVAAWPEEVLDDLTNLNYEVGRAAYSRESLSKMNTIMAEQRVGLHDARKIAFGVDDTWAPALPQLSEPTGQPTVDRVLPIVRRIVMAAYERYGVPEAVYIEHARSALLGPAARAEHQREVNANRREREKNRQILIEQGIDDPNRSDIRRWHQVQLQNCLCLYCGQTISAAAGGAELDHVVPRAGGGSNRRENLVAVCRQCNSEKGKLPFAVFAARTQREGVSVEAALERVRGFQWRPADRAVKRGLVHRLKQTAADDPIDERSLESTAYSAVEVRRRLERFYSDHASPEAPRPEIFVFGGSITSEARKAGGIDAIIRLRGKDVKDRFDARHHAVDAAVMTLVDRSVARTLQQRSDMRYAHRLTGSEPAWREHAGDSAAAQSRFAEWKKKSYRLAELLREAISADAIPVIFPLRLGVNRGSVHKDTVRAAVPKRLGDAWSAAELDAVVSPAAHMALSSVFDGAAELPHDDGRMLTVRKRRLHADDTISLLPGHAAAIEVNGGVVEIGESIHHARLVAWRDRKGVIQFGMVRVFTAEIPFMQRLAGKKDVFSIPVHPSTLSYRGVQLRVRKALDAGIAVELGWITQGDEIEIGLDDVASMTPEFRQFIAEIPEQRWRVDGFKDGGRLRVRPALLSAEGDAAVSDLVSKTLDKGSFVNAAGFIGAPSSVVIRRSALGVPRWRSAQGHLPVSFSPYQRAENLL

SEQ ID NO: 7373 - protein, 1108 aa, unidentified
  REGION 1..1108: note = Description of Unknown:uncultivated organism sequence
MNEGVIQYRIGIDVGQNGVGLAAIAFEAGNPSEVLAMVTHRHDAGLDPAAAKQGYSRKKTSGVARRTRRLRRNRARRLKKLDEILTSLGLEVPAHEVPQTWEAWEARAELQEFPIDNEQELHEKLVLAVRHMARHRGWKNPWWSWNTLWEAPTPTSNMNEIRDNARKVFADLPPTATIGQIGFVAAATNRLLRPRKDTTKAKTKRPTPVLNAKVMQEDQLAELRSYWDKQNLPDEWLEKIAKAVFYQTRPKVKPELVGHDDLPGMTKLPRASRSSLEFQEFRIRAAIANLKVKVPGSRQENFLSVGDKNRIVDLLMGWDDDEAPTWADVAEELNISVRDLKRPEFDDSPLRVAPYDRSSNAIRNKLVSLRKDGKEALEWWDTADRDQRSLFATWLGDQSQHDDAFLETSGLSDIIASWSEGVMEKIDSLSLEPGRAAYSIESLKILNRHLAEGDNLHEARKHGFNVDDSWTPSLPRFEDRTGQPVVDRVIRIVHRFINGCVYKWGVPESIVIEHVRSGLLGPEALLDYKRETTRHRNEREQIARDLKDQGISERPSSGDITRMRIVQEQQGVCLYCGTAINIHCELDHIVPRAGGGSNFRENLAAVCRECNRLKGKTPFARWARETSQEGVSLEGALDRVKNFSVNGSTADLRNLKRRVSQRLRQTDEDQPIDERSMASTAYAALEVRDRVREFTSRFTDTDIPVEVYRGSITSAARKAGHIDKLILLRDKDIKDRGDFRHHAIDAAVMTVINRSNSQVFAIREAMRSAHAMTGSEPNWKDFRGNSPRQEEKFIEFETRAAHLARIIRERIDADRIPVISPLRLKPETGKVHADTIVPFDYKALESEWTDKDIVRVVDNELYLALVDALGGKKVLPTDKISVIDQDLAKDHRQVALYGTPSPQIPVRGGSAAISDSLHHFRVYAWKDKKGAIQFGQQRVFGAEFRAMWGDPRQVDVFTAPVPRWAFAHREMPPKVKAAIEAGNAKQIGWYTRNDEIELDLSELMAQSNVLGEFLRELPEKSWRIRGSHSLSRLSLSPLYLSSEGTDLSEQSRPVQDAVSKGIPVSASSILDSESMIIRRGPLGIPKWNGGNATSYSFRQVAEEVLGTD

SEQ ID NO: 7374 - protein, 1137 aa, unidentified
  REGION 1..1137: note = Description of Unknown:uncultivated organism sequence
MERPLTNSTHEPIDSVTSPRWTLGVDLGHRSVGLAAVALDPDGTPSEILASNVVRLDGGLLPGSEKSPVSRKAAAGMARRVRRLHRRRRARLKALDRHLMDLGFPVDDGPETYESWLDRAHLVEGRIADETERRRATSRAVRHIARHRGWRNPWLSWSAFAELSTPSDNHKRNLAAAAERFDRETEGWTVGQLGAAGTDPRITIRPRTAKDSRRVAQGEAALLEHRVLQEDQLAELRQIWTTQEWDLAELPELEKAVFTQAKPSVPPGNVGRDALPGMQTHQRAPRASLEFQRFRIQSVVGDLRVPVTERSRDLRPLTPEERERVTGLLERWHEREGHVPGERPTWRDVAEAVGVSLRNLRGRDTSDYATATPPTMETLDRLKAGIAALKPAAVRRDVAAWFDEADENQISAFVSYLADSTDTADEALEEAGLTDVITGWDDTALEKLGDLSLEPGRAAYSVQSLRRLADRMQSDAIDLQEARKREFGVDDSWTPPTPSIETPTGMPAVDQNLVAVRRFVMSMVSQFGMPQLVVIEHVRESFLGVTAVEELRRQQRLDRRRREAAEHEVAIASGSQPKAADVRRYSLIQRQNGQCAYCGAAIGLRNSELDHIVPRAVGGASTRANLLAVCRACNNLKGKQPFAVWADGDTRTDEAGEKLVSVEGALARTRSWMTPRPSIRERNELREIRQRLRQRESDEPIDERSMESTAYAATALVERLRNFFETQTADGGQIPPVRVYRGSITASARKSSGVDAIVRLRGKSMKHRGDFRHHAIDAAVCALMTPSVARTLAIRESLRTAHRFTGDEHDWKSFTGDSPQARAEHTAWTARMQTLAKLLRDAVDADQVPVSIPLRLGRRVGRVHEDIIRPFETRELGGTWSPKELERIVDRRLYTVLHDRASSATSGMEVTEELCAELGSTVETTVDLYGSPAAQIPVRGGSARLGSIHHARLYAWHGTRGIEFGMVRVFAGELAAMWPSPATDVLTAPVPTWSMSYRRAAPPVMKRLRADTAVPIGWIAPGDEIVVLPRQEGARASSLDDLVASVGEDRWTITGFEQPGIINIVPRLLSAEGISEETPEAVASVLTRSGRPSTNSLVPRIRVIRRDALGRERQRGGGRLPSSFVPFEVAEQRLQGD

SEQ ID NO: 7375 - protein, 1131 aa, unidentified
  REGION 1..1131: note = Description of Unknown:uncultivated organism sequence
MTNHSPAGSISSTDWVLGVDLGQRSVGLAAVALDPDGTPTEILASNVVRIDGGLLPGSEESPVSRKAAAGMARRVRRLHRRRRARLKALDRRLMDLGFPVDDGPETYESWLDRARLVEGRIANETERKRATSRAVRHIARHRGWRNPWLSWSAFAELSTPSDNHRRNLAAAAERFDRETEGWTVGQLGAAGTDPRITIRPRTAKDSRRIVHGEAALLEHRVLQEDQLAELRQIWTTQEWDPAELPELEKAVFTQAEPFVPPGNVGRDALPGMQTHPRAPRASLEFQRFRIQSVVGNLRVPVTERSGDLRPLTPEERERVTGLLERWHEREGHVPGERPTWRDVAEAVGVSLRNLRGRDTSDYATATPPTMETLDRLKAGIAALKPAAVRRDVAAWFDEAEDDQISAFVSYLADSTDASNEALDEAGLTDIITGWDEAALEKLGDLPLEPGRAAYSLESLNRLTGRMQADAVDLQEARKREFGVDDSWTPPTPSIETPTGMPAVDRNLVAVRRFVMSMVSQFGMPQLVVIEHVRESFLGVTAVEELRRQQRLDRRRRETAAKEVAAASGKEPRAADVRRYSLIQRQNGQCAYCGTAIGLRNSELDHIVPRAVGGASTRANLLAVCRACNNLKGKQPFAVWAAADTRTDEDGEKLVSVEAALARTRSWMAPRPSIRERNELREIRQRLRQRESDEPIDERSMESTAYAATALVERVQNYLESQTPEGVQTPPVRVYRGSITASARKSSGVDKVIRLRGKSMKHRGDFRHHAIDAAVCALITPSVARTLAIRESLRTAHRFTGDEHDWKSFTGDSPQARAEHTAWTARMQTLAKLLRDAVDADQVPVSIPLRLGRRVGRVHEDKVRPFDSRPLGGTWSAKELERIVDRRLYTALHHVAASATSGVEVTPELCTELGSSMGATVKLYGSPAAQIPVRGGSARLGAIHHARLYAWRGTRGIEFGMMRVFAGELTAMWPSPATDVLTAPVPEWSMSYRRTAPAVMQQLRSDTAVQVGWIAPGDEIVVLPPREGARASSLDSLVSSVGEDRWTVTGFERATTINVAPRLLSAEGISEETPKAVTSVLNRPGRLAASSLLPRIRVIRRDALGRERRRGGGRLPSSFVPFEVAEQRLQGD

SEQ ID NO: 7376 - protein, 1133 aa, unidentified
  REGION 1..1133: note = Description of Unknown:uncultivated organism sequence
MSTDMKNYRIGVDVGDRSVGLAAIEFDDAGFPIQKLALVTFRHDGGLDPTDNPKSRKETRGEARRRMRMTRRRKQRLCDLDKVLENLGYTVPEGPEPETYEAWTSRALLASIKLASADELNEHLVRAVRHMARHRGWANPWWSLDQLERASQEPSETFEIILARARELFGEKVPANPTLGMLGALAANNEVLLRPRAEKKKKTGYVRGTPLLAAQVRQIDQVAELRRICEVQDIEEQYETLRNAIFAHKVAYVPTERVGKDPLAPSKNRTIRASLEFQEFRILDSVANLRVRTDSRAKRELTEGEYDAAVEFLMGYTAKEQPSWADVAEEIGVPGNRLIAPVLEDVQQKTAPFDRSSAAFEKAMSKKTEARQWWESNDDDQLRSLFIMFLADATNDTEEAAAVAGLPELYMSWPAEEREALSNIDFEKGRVAYSHETLSKLSEYMHEYRVGLHEARKAVFGVDDTWRPPLAKLEEPTSQPTVDRVLTILRRFVLDCERQWGRPQAITVEHARIGLMGPVQRQKILNEQKKNRGENERIRNELRESGVENPNRAEVRRHLIVQEQECQCLYCGTMITTTTSELDHIVPRAGGGSSRRENLAAVCRYCNGKKNRKLFYEWAGPVKMQETIDRVRQLRAFKDSKKAKMFKNQIRRLKQTEADEPIDERSLASTSYAAVAVRERLEQHFNEGLTLDDKSRVVLDVYAGAVTRESRRAGGIDERILLRGERDKNRFDVRHHAVDAAVMTLLNRSVALTLEQRSQLRRAFYEQGLDKLDRDQLKPEEDWRDFIGLYPASKEKFLEWKKTATVLGDVLAEAIEEDSIAVVSPLRLRPQNGSVHKETIAAVKKQTLGSSWSADAVKRIVDPEIYLAMKDALGKLKELPEDSARSLELSDGRYIEADDEVLFFPENAASILTPRGVAEIGGSIHHARLYSWLTKKGDLKVNVLRVYGAEFPWLMRESGSSDVLRMPIHPGSQSFRDVQEETIEMIEGGFAKEIAWITQNDELEFDPVEYINLPGRSDKLTRFLIYMPETRWRVDGFPESRNLRIRPLMLSQEDLPSEIKKHKEEKQLSDEEKLLVEALEKGLIITSSKLLGLKSIKVIRRNNLGFPRWRGNGNLPTSFEVRSSALRALGVEG

SEQ ID NO: 7377 - protein, 1134 aa, unidentified
  REGION 1..1134: note = Description of Unknown:uncultivated organism sequence
MSTDMKNYRIGVDVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRDQLHPGEDWRNFTGLYPASQKKFLEWKDAATALGNVLAEAIEDDSIAVVSPLRLRPQNGSVHDETIDPVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEG

SEQ ID NO: 7378 - protein, 1135 aa, unidentified
  REGION 1..1135: note = Description of Unknown:uncultivated organism sequence
MSEHTKYRIGIDVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEVTLGMIGALAASNNVLLRPRTYRKDQPRHSKKLNVLGQEPILVDKVRQEDLLAELRTICKKQNIEDQYEKLAQAVFEQTRPYVPLDRVGKDPLQPNKSRASRASLEFQRFRILDAVAHLRVRVGVSDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDAVLERTIGDAWTVDQVHRIVNPQIYLAFAGYLGKQKALEPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSDTVCKHIEQGVAQEIGWVTQNDELEFDPDDYLQNGGKDKLAKFLSFMPENRWRIDGFQTSTKLRIRPALLSWEELPTRLYGKELAENQYALLEESLKTGLIIATKGLLSLESSKIIRRNNLGIPRWRGSSYRPVSLDIQRAALAALDEQE

SEQ ID NO: 7379 - protein, 1132 aa, unidentified
  REGION 1..1132: note = Description of Unknown:uncultivated organism sequence
MSADSLNYRIGVDVGARSVGLAAIELDDDGFPLKKLAMVTFRHDGGMDPATGKTPKSRKETAGVARRTMRMRRRKKKRLKDLDKKLRDLGYFVPRDEEPQTYEAWSSRARLAESRFEDPHERGEHLVRAVRHMARHRGWRNPWWSFSQLEEASQEPSETFGRILERAQHEWGERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVAVDVYGGSLTRESRRAGGIDKSIMLRGQRDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRPQNGSVHKDTVEAVLERTVGDSWTDKQVSRIVDPNTYIAFLSLLGKKKELEADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLGILPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 7380 - protein, 916 aa, unidentified
  REGION 1..916: note = Description of Unknown:uncultivated organism sequence
MSTDMKNYRIGVDVGDRSVGLAAIEFNDDGLPIQKLALVTFRHDGGLDPTKNKTPMSRKETRGIARRTMRMNRERKRRLHKLDKVLEGLGYTVPEGPEPETYEAWTSRALLASIKLASADELNEHLVRAVRHMARHRGWANPWWSLDQLERASQEPSETFEIILARARELFGEKVPANPTLGMLGALAANNEVLLRPRDKKKRKTGYVRGTPLMVAQVRQGDQLAELRRICEVQGIEDQYEALRLGVFDHKHPYVPKERVGKDPLNPSTNRTIRASLEFQEFRILDSVANLRVRTGSRAKRELTEAEYDAAVEFLMDYTDKEQPSWADVAEKIGVPGNRLVAPVLEDVQQKTAPFDRSSAAFEKAMGKKTEARQWWESTDDDQLRSLLIAFLVDATKDTEEAAAEAGLSELYMSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHARTGLMGPTQRQKILNEQKKNRADNERIRDELRESGVDNPSRAEVRRHLIVQEQECQCLYCGTMITTTTSELDHIVPRAGGGSSRRENLAAVCRDCNAKKKRELFYAWAGPVKSQETIERVRQLRAFKDSKKAKMFKNQIRRLKQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRDQLHPGEDWRNFTGLYPASQKKFLEWKDAATALGNVLAEAIEDDSIAVVSPLRLRPQNGSVHDETIDPVKKLTLGSAWSADDVKRIVDPEIYLAMKDALGKLKALPEDSARSLELSDGRFVEADDEVLFFSKKAASILTP

SEQ ID NO: 7381 - protein, 1132 aa, unidentified
  REGION 1..1132: note = Description of Unknown:uncultivated organism sequence
MSADSLNYRIGVDVGDRSVGLAAIEFDDDGFPIKKLAMVTFRHDGGMDPATGKTPKSRKETAGVARRTMRMRRRKKKRLKELDKKLRDLGYFVPRDEEPQTYEAWSSRARLAESRFEDPQECGEHLVRAVRHMARHRGWRNPWWSFSQLEEASQKSSETFGRILERAQHEWGERVSDNATLGMLGALAANNNILLRPRRYEHNPKTGKNAEKLNVRGQEPILLDKVRQEDVLAELRRICEVQGIEDQYPELAHAVFTQVRPYVPTERVGKDPLQPMKIRASRASLEFQEFRIRDAVANLRIRVGGSERRPLTEEEYDRAVDYLMEYSDTAPPTWGEVADELEIAENTLIAPVIDDVRLNVAPYDRSSAIVEAKLKRKTQARQWWDDDANLDLRSQLILLVSDATDDTARIAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAVEQDTIPVVNPLRLRPQNGSVHKDTVEAVLERTVGDSWTDKQVSRIVDPNTYIAFLSLLGKKKELEADHQRLVSVSAGVKLLADERVQIFPEEAASILTPRGVVKIGDSIHHARLYAWKNQRGDIQVGMLRVFGAEFPWFMRESDVKDILRVPIPQGSQSYRDLAATTRKFIENGQATEFGWITQNDEIEISAEEYLATDKGDILSDFLGVLPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 7382 - protein, 1131 aa, unidentified
  REGION 1..1131: note = Description of Unknown:uncultivated organism sequence
MSEHTKYRIGIDVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGVSDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETTRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVNPLRLRPQNGSVHLDTVDGVLERTIGDAWTVDQVHRIVNPQIYLAFAGYLGNQKALGPDSNRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAVEIGWLTQNEELEFNPESYLQEGGKDKLAKFLAFLPETRWRVDGFPMPDKLRIRPALLSREEIPEGVFGTEEQSLLEEALTKGLIIATKGLLSLPDVKVLRRNNLGIPRWRGGSYRPVSLDIQRAALAALDEQE

SEQ ID NO: 7383 - protein, 1132 aa, unidentified
  REGION 1..1132: note = Description of Unknown:uncultivated organism sequence
MSADSLNYRIGVDVGDRSVGLAAIELDDDGFPLKKLAMVTFRHDGGMDPATGKTPKSRKETAGVARRTMRMRRRKKKRLKDLDKKLRDLGYFVPRDEEPQTYEAWSSRARLAESRFEDPHERGEHLVRAVRHMARHRGWRNPWWSFSQLEEASQEPSETFGRILERAQHEWGERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRPQNGSVHKDTVEAVLERTVGDSWTDKQVSRIVDPNTYIAFLSLLGRKKELDADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLGILPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 7384 - protein, 1132 aa, unidentified
  REGION 1..1132: note = Description of Unknown:uncultivated organism sequence
MSADSLNYRVGVDVGDRSVGLAAIEFDDDGFPLKKLAMVTFRHDGGMDPATGKTPKSRKETAGVARRTMRMRRRKKKRLKDLDKKLRDLGYFVPRDEEPQTYEAWSSRTRLAESRFEDPHERGEHLVRAVRHMARHRGWRNPWWSFSQLEEASQEPSETFGRILERAQHEWSERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELRAGGVENPNRADIRRNSIIQDQESQCLYCGKEIGVLTAELDHIVPRAGGGSSKRENLAAVCRACNASKGSRPFAVWAGPARLERTIQRLRELQAFKTKSKKRMLNAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWHDFIGRGEASQSKFLHWKKTAVVLADLISEAIEQDTIPVVNPLRLRPQNGSVHKDTVEAVLERTVGDSWTDKQVSRIVDPNTYIAFLSLLGKKKELEADHQRLVSVSAEVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLGVLPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 7385 - protein, 1131 aa, unidentified
  REGION 1..1131: note = Description of Unknown:uncultivated organism sequence
MSEHTKYRIGIDVGDRSVGLAAIEFDDDGFPLSNLAMVTYRHDGGLDPTTNKSPKSRKETRGVALRTMRMRRRKKSRLKELDKTLRALGYVVPACEEPQTYEAWKSRALLATTKVEGAQELGEHLVRAVRHMARHRGWRNPWWTLNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGVSDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWCDFMGLGPAAQEKFAKWKKTAYVLADIIKEAISNDAIPVVNPLRLRPQNGSVHLDTVDGVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGSSYRPVSLDIQRAALAALDEQE

SEQ ID NO: 7386 - protein, 1131 aa, unidentified
  REGION 1..1131: note = Description of Unknown:uncultivated organism sequence
MSEHTKYRIGIDVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGVSGRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTKKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDAVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALDEQE

SEQ ID NO: 7387 - protein, 1131 aa, unidentified
  REGION 1..1131: note = Description of Unknown:uncultivated organism sequence
MSEHTKYRIGIDVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTLNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGVSDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETTRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGRPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWRKTAYVLADIIKEAISNDAIPVVNPLRLRPQNGSVHLDTVDGVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALEEQE

SEQ ID NO: 7388 - protein, 1132 aa, unidentified
  REGION 1..1132: note = Description of Unknown:uncultivated organism sequence
MSADSLNYRIGVDVGDRSVGLAAIEFDDDGFPLKKLAMVTFRHDGGMDPATGKTPKSRKETAGVARRTMRMRRRKKKRLKDLDKKLRDLGYFVPRDEEPQTYEAWSSRARLAESRFEDPHERGEHLVRAVRHMARHRGWRNPWWSFSQLEEASQEPSETFGRILERAQHEWGERASDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARIAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLEHTIQRLRELQAFKTKSKKRTLKAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWHDFIGRGEASQSKFLHWKKTAVVLADLISEAIEQDTIPVVNPLRLRPQNGSVHKDTVEAVLERTVGDSWTDKQVSRIVDPNTYIAFLSLLGKKKELDADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLGILPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 7389 - protein, 1120 aa, unidentified
  REGION 1..1120: note = Description of Unknown:uncultivated organism sequence
MAECIYRIGIDVGDRYVGLVAIEFDENGVPLRFLERLVVHHDGGLYPGTGTTPRSRKAEAGAARRTRRMRKRKRQRLKALDRYLAKHGYPDVQPQITPYDAWHARARLVSTKIDDEDQLKNDLALALRHIARHRGWRNPWKTLASTRKLPVPSETLLANQARAREHFGDEVNDLTTIGQIGALAASRDYLLRPRNITVTKGVNQKKNVNDLERSSEEALAAGHPTAPILGWQVRQEDQINEVERIWERQGLPSEELPQILTLLFAQTKPHVPSERVGRDALRPKLYRAPIAALEFQDFRILAAIANLRVRTEGSRRLTKDERFTAFQFMSGWREKEPLSWADVAEELGFSAHALAAPTTETNQRLAFAPTNRTLTTLGTFFKGKKIDAGAREWWQSASYAERSLLAQLIADATPDTQEQADASGLADVLLQWDEDTVADLMELDLQSGRAAYSTDTLLRLNARMENDGTDLFESIQAEFNIDPSRLPRPDWDDQTGQPTVDRVLTIVRRFVGGCERKYGKPESVTVEHVRTGLMGAEQRSSIIAENNRNRRDSDRIRTELQADGIREPSRLDVRRHRQVQRQNCTCLYCGTAITTTTCELDHIVPRRGGGSSQGSNLVAVCRECNASKAHRIFAEWAEDSQREGVSVKEATKRVRHWLNASASMKREVTRRLQQKRTDPPIDERDLASTSYAATEITRRILGHFHDEVPVVAFGGSGTREARRAGRVDHIIRLRGSLDKSRLDTRHHAIDAAVLTLQSPAIYRVLLTRVNLKREHEVTGEAPEWRDYEGADQAEKVLYRRWQKNIATLAELMRQEIENNRVPVTRPIRLRKSRGAVHKDEIQKPEKYPPMLWGEWNSTAIDRVIDPELHLALRKLLTSTKSNKITVDATTPGLPDRYRSNSLIPLFAQDAPAMMSPRGIILIGKARHHARILTWDDPKKGPQLGIQRVFAAELGEMLKDASSNDLFEAPIPFHTMSHRDLQPQVRAAVEQGLTRQIGWITLGDEIEIDPSDFAEDTTKFGKFLREFPERNWSIAGLKESRKLVLRPLMLSAEGASPANSSLTAEVLDGGVKVHPSTLLASPGTTIIRRTGLGRPRWDSGLAHLPESFNVHARMTQQSARD

SEQ ID NO: 7390 - protein, 685 aa, unidentified
  REGION 1..685: note = Description of Unknown:uncultivated organism sequence
HRVGLHEARKAVFGVDDTWRPPLAKLEEPTGQPTVDRVLTILRRFVLDCERQWGRPRAITVEHARIGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSLASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 7391 - protein, 1071 aa, unidentified
  REGION 1..1071: note = Description of Unknown:uncultivated organism sequence
MAEQPCGEYVLGIDLGTNSVGWAIIGLVDGEPTKLLRAGVRVFEAGMEGDIESGQEQSRNLKRREARLHRRQLWRRARRMTKTFNLLRQFGLLPEGDASTPEKRQDFINKLDQDIRASEWFKARAKSGAYPEPEQTLPYILRSAALDEPLEPHFLGRALYHLAQRRGFLSGRLRPAKTGEEEGKVKGAIKTLRAQMAEKGSRTLGDFLSHLSPTERRIRGPEAWTARSMYEEEFERIWTAQAQHHPSLLDEQRQKKIRQALFFQRPLWFDPDTVGQCELEPGERRAPAYLLTAQRFRLLQKVNDLQIEEPDRAPRYLTPEERAKLSDALELQGDLPFHKDRKVEGRVLPSVRTLLGLPNKVLFNLQRGGEERMQGNRTTSEFYAVFGERWLDMSAEEHKYAILDVLSIHKPEALRRRAMGHWKLSAEAADRFCEISLEPDYMNLSRKALENLLLVLEQGIPLQTARKQLYPESFKASEPKPLLPPVEQSLTEIRNPAVMRSLTEFRKVVNGLIRSYGKPAYIRIELARDLKKSKKQRTAVSEINRRNEKARAKAAEDIVKGGVGIREPKREDIRKYQLAEECHWQCPYTGKTISVQALFGPEPQFDIEHIIPFSRSMDNAFQNLTLCYVPENRSAKGNKTPHEAYSSHPERYQAILDRVKRFTGEHAMVSAKLRRFTMAEDELQEFLADFRNRQLNDTAYASTLATRYVGLLYGGPADAEHRQRVFAPSGQTTAYFRNLWKLNGILNDGPSRDGGRIEKSRDDHRHHAVDAVVIGLTDTGMVKRLSDAAQRAPSAGHKRFAALEGPWPNFVETVREAIRQIIVSHRISKKVSGALHEETVYSPPQADGSVRVRKPLAALTKHEVESIADDRVKALVVSKLAGGEPKKVFATEENLPHFETSDARRIPIKRVRIKKAVPTFSLGGGRTTRHVATESNHHIEIFAELDQQGKEREWDGIVVPMHEAWRRLRAGEPVVNRDAGPGRLYKFSLAQGEVVECDGKHEGRSLFVFRKVTQFTKGGIQIGFAPLNDARKAREMQVARAWLWTTPNTLGDRHARKMTVNPLGEVTEAHD

SEQ ID NO: 7392 - protein, 1028 aa, unidentified
  REGION 1..1028: note = Description of Unknown:uncultivated organism sequence
MQRLKEYVLGIDIGTTSIGWAVVETHDGQPTDIVRTGVRIFEAGVDGTIEKGKDSSRAAARRTARQQRRQTFRRKCRIRRVARCLENLGLLPTGAGGDGQTRHRVLDDLDCALREVYCPVGHDISQQVWVYTLRATAGMQPLPRFHVGRALLHLAQRRGFRSGSKQMETKADDTEQGEIKEAIEKLSQELSGRTLAEVFCQRNPHQQRIRKNWTAREMYQAEFAKIWATQASSLGLTDDAKQELAKAIFYQRPLRSSKGLIGRCSLETKHRRAPAACLAAQEFRILQTVNHLRLQFADGMTAPLIPEQRDQLISALNEKSKLTTATAKKLLAIPKTVKFSIESHSEKELPGNRTATPIVEILGQRWLKWTESEQDALIDALLSFQKAHALTRHLQKRWGLSVSEAEQLAEIRLETGYCRHSRQALAALLPHMRQGLAYANAVEAVYGSVRRPTKPRRRLPVVSTAIPDMTNPAVHRALSELRKVVNAVLQQFGKPTRIRIELARDLKRSRVERKRLSELNDKNQKQREAALRKLVAECPGARESRDSIEKILLAEECGWECPFTGDGISMQTLFGSTPRFDVAHIYPRRYLDNSFANKTLCRSDVNRNRMYDLLPRQAFASNTEEWNLILTRVKGFKSTSAAEKLRRFQAEAVPDDFVSRQLNDTRYNSVIAAQYLSLLYGGRSDEQGQRIEAVTGGMTAVLRSVWRLHKSRDDHRHHALDAVVIACTDAGTVRLLQSAAAEADRHKTRLTEIAFPAPFSGFAARVEESLGCVAVSFRPDRRVQGAFHDQTLYGRPVSKSGKPEKTRLRKELHKLSRSEIEGEQIVDPVIRRIVQEKWASLGKPDPKRVFADPANHPVLREKSGGVRPIHKVRVWQNVKPAKIATDDRERFVQLNANDHTVIYAELSEDGSDQRWRESVVTRFEALSRVRFGDPPVLRTLQQGLVFRFSLRRNDCIELADPDGMRRLYRIMNVSKGDMQIQQLSDARSSKVLRDNKLRLRITNVDELRRRCCRKVQVSPLGDVFADNT

SEQ ID NO: 7393 - protein, 1080 aa, unidentified
  REGION 1..1080: note = Description of Unknown:uncultivated organism sequence
MPSSAGSSQKYTLGLDLGSASLGWALIALGDADEPIGLLRTGVRIFEPGVDGTTLDIERGKDQSKAVDRRMERLRRRQLRRRAARQRELFHLLQAHSLLPPFQELASGSEAAKLASSEARHAILNALDQQLQMKWGEAGNSVNPEKFAQLPMYCLRKAGLDETLEPYEFGRVLYHLIQRRGFKSNRRETAKSPEKDKELGAVKAGISQLEQEMHTANARTLGEYFSTLDPHQQKVRRRWTARAMYEHEFNLLWEAQFVHYPDLLTSDLRTQIATLLFFQRPIAAQSHLIGKCDLEPDKRRAPWTSMEAQQFRILQKVNDLKLIEPGNPDAQPLTREERASVYTLLDQEGDQTFAAIRKHLGMPKTIQFNLERGDEKRLRGNRTNVTMTQVFGDRWTLFSGEDQKRIVEEWRTSESEESLIRRAMECWGLSEVSAKLWAEKHPEEGYCALSRKAICRLMPLMTSGKSFKEAETETYGDRFSGNEVFDKIPVVRGYLKTLRNPAVERSLTEMRKVVNAIIREHGKPYEIRIELARELKKPRQERVTATKNNRKRQSEREIVKAKILKECGLEYPSRSDIEKAMLYEECGGICPYTGRSITFSNLFHDSQFDVEHIIPISRYPDDSFQNKTLCYHEENRNIKCNQTPFKAYSADEENWAKILERVKKFNNPGKLKRFMLRSEEELEEFSSRQMNDTRYASVLAGRLMGTLYGGRDVATSSGTRQAIFASSGAVTATLRRVWGLESILREAVPSANGQSKGKPRTDHRHHAIDAITIALAKQSVIHAMSRAASADVFTQHSARSFRSLHAPWLDFIASIRPQIEGMVVSHRPEHKMSGELHDATNYGQPYTLNGKPMVHIRKPVNGLSANDIENIVDDEVRCAVREKSVLLAGDLSACSTNNDWPCIRAKDGRQIPIKRVRVKKVLKVKPIASGPRERFVAESSNHHIAVFAQMDAHGREKRWDSVIVSLFEAMERKRKKLPIIQESYPDADNYVFKFSLMGGDLIEIHRNCNHAQETCVPTIYRVRTIATNGQLSLVRVNDARLKQDIQKVKEWWSPMAGTLKQLDCRKVVIDVLGKVHPAND

SEQ ID NO: 7394 - protein, 1072 aa, unidentified
  REGION 1..1072: note = Description of Unknown:uncultivated organism sequence
MSAEQYILGLDLGANSIGWAMLKNHGGKPAGIIKTGVRIFDAGVIGYGSSMEESRNAQRRNARQSRRQTERTANRLNDLFVILQKAGLLPVNSVPLDSNLSRKEISQQKDRLLKKLDAELAVAWNEKLKARGEDEYSIQIKTYHNLPYLLRAAGLDERIELHEIGRALYHLAQRRGFERTNKKGKSEKQKEDEGKVAEETHFLQSEMDKANARTLGEYFVRLDPFADNSNKIRGRYTLRDMYKKEFNLIWDKQAAFYPQHLTPELKEVIYHIIFFQRPLKSQKHLIGDCQFETGHKRAPWASLQAQQFRMLQKINDTRIIMPDGSVRDLTSEERIALIARLENEGDLTITDAKKFLNLPHKAKINLEGGGETRLIGNRVSTAFYKVLGDIWSSWSDEQKQRIVAEVINCQENERGFSEKIITEFKLDEKMALSMLMVNLEPGYCKLSKRAIRKILPLLENGTSYATAVKEIYGDCPKEQPRDMLPPVFDYDDDIRNPVIIRALTELRKVINAIVKEYGKPEAIRIELARDMKKSRKQREETWKISRRKEAERKKAADSFLKETNRTATSQDILKVMLAEEANWRCPYTGTTISFSTLGNFDIEHIIPFSRCFDDSYINKTLCLAEENRNVKSGKTPFEAYSGNAERWSGIIGRVKTFKCDKGMKQAKLQRFLMEGPADWDDFVSSQLNDTRYVSKIAMEYLGLLYGGVIDERGKRRIQAGRGGITAHLRNVLNLNRVLGDGGKKERTDHRHHAIDAVAIALTDHHIFKTLSEASKRASAERRRLFGNVAEPWEGFLENVRQSVKELIVSHRVAHRIRGALHEETIYSKPIKASDGKEYVHVRKKVSALTPSDIKNIVDKRIKEIVINKLRDLGYNPEKLGEREIQKAFGNAENLPFLSAIDKRTGQQRNIPIKKVRVRKSETVMLVGSGHTERCVTSGLNSHIEIFEEMQKNGEIKWTGKTVSMFEAAQRLKKREPVINREQTDNRRFVCSLALGDIIELEEERGKKELFVIKTITIQRRKNTDYSQVFYAPINLSNPKKEGLKGKLINKLKELNCRKVIITPLGEVRQAND

SEQ ID NO: 7395 - protein, 905 aa, unidentified
  REGION 1..905: note = Description of Unknown:uncultivated organism sequence
MYHLAQRRGFERTNKKGKSEKQKEEEGKIAEETHFLQLEIEKANARTLGEYFVRLDPFADNSNKIRGRYTLRDMYKKEFNLVWNKQAAFYPEQLTPALKETIYHAIFFQRPLKSQKHLIGDCQFEPGHKRAPWASLQAQQFRMLQNINNTRIIMPDGSVRDLTSEERIALIARLENEGDLTITDAKKLLNLPHKAKINLEGGGETRLIGNRTAAAFHKILGDIWISWSDEQKQRLVAEVINCQENERGLPEKIIVEFNLDEKMVLSLPKINLQPGYCNLSKKAIKKVLSLLENGTAYATAVKEIYGDRPKDPPRDMLPPVSDYDDDMRNPVVIRALTELRKVVNAIVKEYGKPEAIRIELARDMKKSRKQREETWKVSRRKEAERKKAADTFVQETGQTPAPQDILKVMLAEEANWRCPYTGTPISFSTLGNFDIEHIIPFSRCLDDSYINKTLCLAEENRKVKSEKTPFEAYSGNAERWTEIIGRVKTFKCDKGMKQAKLQRFLMESPTGWDDFVSSQLNDTRYVSKIAMEYLGLLYGGIIDESGKRRIQAGRGGITAHLRNVLNLNRILGDGGKKERTDHRHHAIDAVAIALTDHQIFKTLSEASKRAAAERRRLFGNVSEPWDGFLEDVRQSVKELMVSHRVSHRIRGALHEDTIYSKPIKASDGKEYVHVRKKVSALTPSDIKNIVDERIKEIAINKLRDLGYNPEKLSEREIQKAFGSEGNLPFITATDKKTGQQRKIPIKKVRVRKSETVMTVGSGHTERYVTSGLNSHIEIFEEIQKNGKTKWTGKTVSMFEAAQRLKKLEPVINREQTDNRRFVCSLALGDIIELEEEHGKKELFVIKTITIQRRENTDYPQVFYAPINLSNPKKEGLKGKLINKLKELNCRKVIITPLGEVRQAND

SEQ ID NO: 7396 - protein, 1035 aa, unidentified
  REGION 1..1035: note = Description of Unknown:uncultivated organism sequence
MILGLDIGTNSVGWALINTDSDGKPVGLHAAGARCFDAGLDGDVGSGRGEPRNAKRRDARQARRQGWRRKRRRKNLIGILQKHELLPASIERTPQGIHDGLVALDTSFKKTNPPKNHREEQLLPYILRANAAKEKVELFELGRALYHLAHRRGFLSNRKESEKEDDETGAVKGGIKDLREFIEESGEATLGGYFSTLDPSDARIRQRWTGRQMYIDEFNIIMDEQQKHHDISGETRKELYKVIFDQRPLKSVAHLVGRCELEPKERRCLMALPIAQQFRLLAAVNNLMIEEDEYSQRMLTKDERDTLIEALTTQGDLTFAKIRGKTILGLPRGTSFNLEKGGEKRMCGDRTTSAMVNIFGDKWDEMSVKDKERVINDLRSYEKTDALRRRGKQEWQLEGEALQAFLDVRLEQGYGNISRKALLKLVPNLEDGTPYSTARKNEYKESFLADEPHEKIPIVEKLFPNLRNPVVSRSLSEVRRVVNAICKEYGIPEVVRIELARDLKQSQKHRRDATKKMRDRESEREKARGRIIAETNISNPSRNDILKVLLMDECGGICPYTGRSFGMRDIISSAPTMDIEHIIPFSRSLDDSYINKTLCDAHFNRNIKKNKTPWETSGGTDEWNKILNRVGKFKSQVRHLKLQRFELDEVGEELIEEFASRQLNDTRYASKLAAKLVATLYGGTSDEDGTLRVQTCAGRATAYLRNGWELNGILDDGPRKTRNDHRHHAVDAVCIALCDAKSVKLIAKAAEQLEERYHKLIGNIRAPWNGFVPSIREVIENIVVSHRVDCRLNGALHEETNYGVSIQDNGETLTRIRKPIEALTSGEVNRILDPRVKKAVLDALDGKPAKTAFKDRENHPRLETKNGQSIPIHRVTVEPKIKNTVSVGSKGAPRHIAPGSNHHMAVVAVLNEKGEEIKWEGHVVTRLEAIQRKSRKEPVIQQIWGDTEKSLKRVFKFSLRSGDTITLEHGEKGGVWLVCGVSGKLIQVRRNNDARLKKDICSAGDWWQPAINSLRNSCLQRLSVQATGVLRNWNA

SEQ ID NO: 7397 - protein, 1060 aa, unidentified
  REGION 1..1060: note = Description of Unknown:uncultivated organism sequence
MDNVAKYTVLGLDLGSNSVGWALIEYRDGQPSALTGCGVRVFDAGTEGDVESGKDTARGVERRDARQRRRQCERRGRRLENLAGILSRNGLLPKGALRKPAERHRLLQTLDREIDARYRNAASADEKIASALDQLPYFLRSRALDHPLEPHELGRALYHLAQRRGYLSNRKSGKKDEDKGTVEPAINELRERMSAAGVRTLGEFLAQVDPVNERRLRHRWTARDMYLDEFEAIWAAQQPHHPKLLSDALKKVLTEAIFYQRPLKSQKGLIGVCDLVPGKKRAPKALLISQRFRMLQKVNDLEVIFADESHRRLTEEERHAVLQAMEEKDKITFAQIRRAAKLPQGVEFNFQRGGEKNLPGNKTATALRAVFGEQRDRFPRETQDAIVGEAMGIEQAETLERRGRDAWGLDPEAAAAFGKVHLESGYMALSREAMRALLPLMEQGMQFATARDQAFEGNWARNVLDQLPGVAEACKTIRNPVVMRTLTETRRVVNAIIRSYGKPDYIRIELAREMKKSRKERKKISTEIQKRRKANDARRQKIIDTTGDPRVTGRDILKARLWEECCGICPYTRKSIPFHELFSQDSPWDIEHIIPFSRCLDDSFFNKTLCYHEENRNVKQNRTPREAYEHSGDWDDIIASVAKFKGDAAREKLRRFQMSAEDLLEFEEFSARQLNDTKFASREARNYLSWLYGSEAPSRIQASRGQITSYLRSAWRLNSILGDGGEKVRGDHRHHAVDAIALTDRATVKALSDAAASQFRERGRSRGFEKRVTEPWVGFLQDVQHTIDGVVVSHRPSRKVAGCFHDDTNYSPPRTDREGKPYVLVRKPLEKGFKATDIQNIADPTVRDIVWQHFRDHDEDPKVAFSNAANHPRIRIKEGPRAGQTIPIHKVRLKYTRDVTRIGRGPTERYIWTRGNSHIEIFEVLGKDGTVTKWQGRVVTRLDAYQRRKQRQPIVNRHWDENRRFLFSLTQGDIIELDVDLGNDEIVRELYLVRGVTFLAGGLIQCSHILDARKKKEIPMKPSADEKIRIFKNPVVNTLNRLRCRKVSVTPLGEVYPAND

SEQ ID NO: 7398 - protein, 1128 aa, unidentified
  REGION 1..1128: note = Description of Unknown:uncultivated organism sequence
MDYKIGLDLGISSVGWAVIQTDCDGNPVKIENLGSRIFDKAENPKDGSSLALKRREARGVRRRLRRRRHRRDRVLSLLEEYNIISKKEVQAMFSNSEYRFEKNVYELRVEGLDTLLTAKELARVLINFVKRRGYKSNSISEEKSDKDIGKLLTATVENDKIMKENDYKTVAQMYLNDERFTTNKNFNDGRKILKIRNTTDSYTSTVRRSDLVNEIKLILQKQKELNSKITDKFIEKYLNIFESQRSFEEGPGGDSPYGGNQIEKMIGRCTLEPKEPRAVKASYTFEYFKLLQDINHIKLECKENIDGKVKNISKSLSNEQRKELINLAKKSDTISFDKIRKVLNLDYNVTFNMVNYNLKKVSNIEDLFSLSEKETKLREFQSYHKIRKILDKIEKGIVDKLSIDTLNKLAYALSVFKNDKSIKKYLKENCRELTDELIENLLEISFSKVGNLSIKAMEKLIPFLEQGLTYDKAVEKVYGKDVNINVKRKNKLSFNTIKDDITNPVVKRAVSQTIKVVNAIVNKYGEPLCINIELARELSKTFEERNRISKKNEERKSENEKAKLEIQEMGKFNVTGQDIIKYRLWKEQDEICIYSGHKITPDELFTELVDIDHIIPYSISFDDTFNNKVLVLSSENRKKGNRVPIEYLRKNGMHVDEYKLRIETTYIKKNNYKKLKKLLVEGITREDIDNFKERNIKDTQYLSRLMYNLLRNNLKFKKNDGIKIKVQAVNGAITSHIRKRLGIEKIRTNGDKHHAIDAVIIAIITPKLIQSITNFYKYNELKNCNIKENKIINEETGEYVDLSKFPQPYQGFREELEIRSLQNENLMHEALKNSKLVRYTDIENVKPIFVSRMPRRKVTGAAHKDTIRGLRKHDNNFYSVTKTPLTKLSLTKDEMDIDGYSEKQKIDDIYLYKALLKRLKEFDGNAKEAFKDSFYKPNKDGSKGAIVKKVKIEKKVSSFVTLNDGKSLAENGSMVRIDVFYIENEGYYLVPVYTKNVIEKNLPNKASIAKKPESEWKEMNDKDFIFSLYPNDLVHIKSKKPIEFIPSENQKLENKLYNDVFAYYVSSDISSASIEIKTHDNEYKRRGLGIKTLLEIKKYEVDVLGEYHEVRIPEKRNDFKNVKGGKKA

SEQ ID NO: 7399 - protein, 1062 aa, unidentified
  REGION 1..1062: note = Description of Unknown:uncultivated organism sequence
MDNVAKYTVLGLDLGSNSVGWALIEYRDGQPSALTGCGVRVFDAGTEGDVESGKDTARGVERREARQRRRQCERRGRRLENLAGILSRNGLLPKGAMRKPAERHRLLQAVDQEIDARYRNAASLDEKTAAALDQLPYFLRSRALDHPLEPHELGRALYHLAQRRGYLSNRKSGKKDEDKGTVEPAINELRERMSAAGVRTLGEFLAQVDPVNERRLRQRWTARDMYLDEFEAIWAAQQPHHPKLLSGALKKVLTEAIFYQRPLKSQKGLIGVCDLVPGKKRAPKALLISQRFRMLQKVNDLEVIFADESHRRLTEEERHAVLQAMEEKDKITFAQIRKAAKLPQGVEFNFQRGGEKDLPGNKTATALRAVFGEQWDRFPRETQDAIVGEAMGIEQAETLERRGRDAWGLDPEAAAAFGKVHLESGYMALSREAMRALLPLMEQGMQFATARDQAFEGNWARNVLDQLPGVAEACKTIRNPVVMRTLTETRRVVNAIIRSYGKPDYIRIELAREMKKSRKERKKISTEIQKRRKANDARRQKIIDTTGDPRVTGRDLLKARLWEECCGICPYTRKSIPFHELFSQDSPWDIEHIIPFSRCLDDSFFNKTLCYHEENRNVKQNRTPREAYEHSGDWDDIIASVAKFKGDAAREKLRRFQMSAEDLLEFEEFSARQLNDTKFASREARNYLSWLYGSEAPSRIQASRGQITSYLRSAWRLNSILGDGGEKVRGDHRHHAVDAIAIALTDRATVKALSDAAASQFRERGRSRGFEKRVTEPWVGFLQDVQRTIDGVVVSHRPSRKVAGSFHDDTIYSPPRTDREGKPYVLVRKPLEKGFKATDIQNIADPTVRDIVWQHFRDHDENSEAAFSNAANHPRIRIKEGPRAGQTIPIHKVRLKYTRDVTRIGRGPTERYIWTRGNSHIEIFEVLGKDGTVTKWQGRVVTRLDAYQRRKQRQPIVNRHWDENRRFLFSLTQGDIIELDVDLGNDEIVRELYLVRGVTLQGGGMLQCTHILDARKKTNIPTTATAQEKIRIYLRPPVNTLNRLRCRKVSVTPLGIVYPAND

SEQ ID NO: 7400 - protein, 1073 aa, unidentified
  REGION 1..1073: note = Description of Unknown:uncultivated organism sequence
MNYRLGLDIGITSVGWAILEHDSSEEPFRIVDLGVRIFNRAENPKDGSALAFPRREARSSRRRIRRHRHRLERIKTLLYNHEIITSEKLQELYHGKMDLIDVYELRYQGLERLLNQEEWARVLIHLAQRRGFKSNRKNDSKTKNDDGKLLAAVKDNQTLMHEKGYRTVGEMFYRDEKFSQHKRNKADLYGHTVGRNQILDEIKLIFNAQREFGNPSTDENFEKLYFDIISGQRSFDEGPGTPSPYAGNLIEKMRGKCTFEKEEPRAAKACYTFELFNLWQRINNLRIDDINMGSRSLSKEEQILLVQLAHEKTDINYKDLRKVLQLAPEHKFNMLTYGPDGLEEIEKKNKFNYLKAYHDIRKSLERVNKGRSKQISADQLDKIGEILTLYKNEDRITNELKKIGLMDHDIDELISLSFRGFSRLSLKAIKNILPHLQEGNIYSDATTLAGYDFRGHENTIKQKYLPANNEQLEDIVNPVVRRSVSQTIKVINAVIRKYGSPQLICIELSREMGKNFFDRKKIEKRIKENTDLNDAVRNKIIEYGHTNPSGLDIVKMKLWEEQDGRCAYSGTSIPIQDLFDPGVADVDHIIPYSVSFDDSYANKVLVKSQENRQKGNLLPLEYMKHDMAKQERFIVWVNTNVRNYRKQQRLLKKTITEEDRKKWKERQLNDTKYISRFMLNYIRDHLEFAPAENIGKRKVVSVNGNITAYMRKRWGLKKDRLAGDMHHAQDAVVVACITEGMIQKVTRYSQYYEAKHSRSIFTDYETGEVIDTRDRFGVNFVEPWDNFKIELESRLSNDPVMRIEAYKLDNYLDLKEVKPVFISRMPNRKNRGAAHQETIRSPRLAEEGLVVSKIDITKLKLNADGEISNYYNPNSDKKLYEALKKRLHQFEGNGEAAFKEPFYKPAASGKISSQVKKVKVIDKSNLNVAVGSGVAANGDMLRIDVFHQEDGYYWVPIYVADTVKETLPAKACVAFKPYELWKEMDDKDFIFSLYPNDLVRYLQKNGNEGFMYYVKAGISTASITVESHDRALSIPSLGVKTLKELEKWNVDALGNRTKVNKEKRQYYPGQMVR

SEQ ID NO: 7401 - protein, 1198 aa, unidentified
  REGION 1..1198: note = Description of Unknown:uncultivated organism sequence
MFINRKLVLGLDLGVGSIGWCLVSKDLQDNPLEIVAIGSRVVPLSTTEVNDFKVGKSKSPSQQKRLVKSFRRNIDRYQMRRYKLVSILKYLNMMPNVELMKAPLIELWSLRSRAATVGEKLSLEEIGRVLFHINQKRGPQFRIDDESTDTVYKEAVNHRHKVIRESKQTVGQYFYCKLQNSRITNPKGKSFYTYRIKDNVLPREAYEEEFMQIMDVQMKFYPEVLTPSIISRLFDTIFFQRELKSCKKLVSVCDIEKREYPIPDKEGQYRIVGPKVAPKSSPLFQVFKIWQSISNISFTDIDGQRLYIKKDVRNKLFNHILTKGKLNARDCYNIVGVSDKEFSLDKLTLDGIKGNLTLNQISKALSLLPVTKRNELLQFDLKVEEQVDTVTGEIHNVISNDMLSEPLYKLWHTLYSLNKADERRKCLQNNFGISDEQTIDELCKLNFKKDGYCKLSSKAIRRILPYLQEGYDYAQSCLLAGFRHSDYVTTEENEGRPLQTHLPILKKNELHQPVVEKVLNQMIGIVNRLIEKYGEIDETRIELARELQRSKKEREDMDKQNRENLKRNEEIAEKLKKENGINKPTHRMLMKYRQFEETGGKCMYCGGDIDLKTFMYGIDTEWEHIIPKALLFDNSFSNSICACQKCNKTKNDRTAYDYMRSLGTQRFNDYKERVKKMYDEKSISRTKYKNLLASFEDYQERKRNGCATEEDKELWENYIDRQIRQTQYISRAALKMLKNVCRNVYASSGTVTSFLRHGWGYDNILHDLNLPVYDAAGIGLTEDVVVKQDGKDIQVHRIKGWNKRMDNRHHAIDALVVACTKQSIVQRLNEFNSSRTEFEEEVKSGKKKRFKNKKSMLEKWVEINTPFSKKEVAEKVSGIIVSYRTSNKVASSSTNRYLSNGKTIVEKGIISPRLPLHESHLYGKINGKNVYRYSLSELFLKKKDVNIEDVLKSIVDKGIVAILENRINAGIINNDSSKKPYDVDPAKAKENLATLVSKPPMHSNGTPIRRVKCYVSKPTIPVRTDSHGTVTAYAVSGNNHHIEFYRNDKGEFKESVISYWQAFLRIKNHLPLFVNIDNASILRKAIEEGFDIGEIHDSSWDPFLCLGKTELVVIGLKKRTIENLIKRGDYSKIASHVYKVCGVSQGDYTFCIHNEIKYVPKERNKPDGRFIRIQNIKSLANLELVKVKINPIGEITIL

SEQ ID NO: 7402 - protein, 1198 aa, unidentified
  REGION 1..1198: note = Description of Unknown:uncultivated organism sequence
MFINRKLVLGLDLGVGSIGWCLVSKDLQDNPLEIVAIGSRVVPLSTTEVNDFKVGKSKSPSQQKRLVKSFRRNIDRYQMRRYKLVSILKYLNMMPNVELMKAPLIELWSLRSRAATVGEKLSLEEIGRVLFHINQKRGPQFRIDDESTDTVYKEAVNHRHKVIRESKQTVGQYFYCKLQNSRITNPKGKSFYTYRIKDNVLPREAYEEEFMQIMDVQMKFYPEVLTPSIISRLFDTIFFQRELKSCKKLVSVCDIEKREYPIPDKEGQYRIVGPKVAPKSSPLFQVFKIWQSISNISFTDIDGQRLYIKKDVRNKLFNHILTKGKLNARDCYNIVGVSDKEFSLDKLTLDGIKGNLTLNQISKALSLLPVTKRNELLQFDLKVEEQVDTVTGEIHNVISNDMLSEPLYKLWHTLYSLNKADERRKCLQNNFGISDEQTIDELCKLNFKKDGYCKLSSKAIRRILPYLQEGYDYAQSCLLAGFRHSDYVTTEENEGRPLQTHLPILKKNELHQPVVEKVLNQMIGIVNRLIEKYGEIDETRIELARELQRSKKEREDMDKQNRENLKRNEEIAEKLKKENGINKPTHRMLMKYRQFEETGGKCMYCGGDIDLKTFMYGIDTEWEHIIPKALLFDNSFSNSICACQKCNKTKNDRTAYDYMRSLGTQRFNDYKERVKKMYDEKSISRTKYKNLLASFEDYQERKRNGCATEEDKELWENYIDRQIRQTQYISRAALKILKNVCRNVYASSGTVTSFLRHGWGYDNILHDLNLPVYDAAGIGLTEDVVVKQDGKDIQVHRIKGWNKRMDNRHHAIDALVVACTKQSIVQRLNEFNSSRTEFEEEVKSGKKKRFKNKKSMLEKWVEINTPFSKKEVAEKVSGIIVSYRTSNKVASSSTNRYLSNGKTIVEKGIISPRLPLHESHLYGKINGKNVYRYSLSELFLKKKDVNIEDVLKSIVDKGIVAILENRINAGIINNDSSKKPYDVDPAKAKENLATLVSKPPMHSNGTPIRRVKCYVSKPTIPVRTDSHGTVTAYAVSGNNHHIEFYRNDKGEFKESVISYWQAFLRIKNHLPLFVNIDNASILRKASEEGFDIGEIHDSSWDPFLCLGKTELVVIGLKKRTIENLIKRGDYSKIASHVYKVCGVSQGDYTFCIHNEIKYVPKERNKPDGRFIRIQNIKSLANLELVKVKINPIGEITIL

SEQ ID NO: 7403 - protein, 1073 aa, unidentified
  REGION 1..1073: note = Description of Unknown:uncultivated organism sequence
MNYRLGLDIGITSVGWAILEHDSSEEPFRIVDLGVRIFNRAENPKDGSALALPRREARSSRRRIRRHRHRLERIKTLLYNHEIITSERLQELYHGARDLTDVYELRYQGLERLLNQEEWARVLIHIAQRRGFKSNRKNDSKTKNDDGKLLAAVKGNQTLMHEKGYRTVGEMFYRDEKFSQHKRNKADLYGHTVGRNQILDEIKLIFNAQREFGNPSTVENFEKFYFDIISGQRSFDEGPGKPSPYAGNLIERMRGKCTFEKEEPRAAKACYTFELFNLWQKINNLKIDDINMGSRSLSKEEQILLVQLAHEKTDINYKDLRKVLQLAPEHKFNMLTYGPDGLEEIEKKNKFNYLKAYHDIRKSLERVNKGRSKQISADQLDKIGEILTLYKNEDRITNELKKIGLMDHDIDELISLSFRGFSRLSLKAIKNILPHLQEGNIYSDATTLAGYDFRGHENTIKQKYLPANNEQLEDIVNPVVRRSVSQTIKVINAVIRKYGSPQLICIELSREMGKNFFDRKKIEKRIKENTDLNDAVRNKIIEYGHTNPSGLDIVKMKLWEEQDGRCAYSGTSIPIQDLFDPGVADVDHIIPYSVSFDDSYANKVLVKSQENRQKGNLLPLEYMKHDMAKQERFIVWVNTNVRNYRKQQRLLKKTITEEDRKKWKERQLNDTKYISRFMLNYIRDHLEFAPAENIGKRKVVSVNGSITAYMRKRWGLKKDRLAGDMHHAQDAVVVACITEGMIQKVTRYSQYYEAKHSRSIFMDYETGEVIDTRDRFGVNFVEPWDNFKIELESRLSDDPVMRIEAYKLDNYLDLKEVKPVFISRMPNRKNRGAAHQETIRSPRLAEEGLVVSKIDITKLKLNADGEISNYYNPNSDKKLYEALKNRLHQFEGNGEAAFKEPFYKPAASGKRSSQVKKVKVIDKSNLNVAVGSGVAANGDMLRIDIFRQEEGYYWVPIYVADTVKKTLPAKACVAFKPYELWKEMDDKDFIFSLYPNDLVRYLQKNGNEGFMYYVKAGISTASITVESHDRALSIPSLGVKTLKELEKWNVDALGNRTKVNKEKRQYYPGQTVR

SEQ ID NO: 7404 - protein, 1060 aa, unidentified
  REGION 1..1060: note = Description of Unknown:uncultivated organism sequence
MAQVFSAYRLGIDLGTNSIGWALVGDDRIIDAGSRVFEAGVEGDIERGREEPRNAARRQARQVRRQLERRARRLRKVYNLLARRGLVPPAGSPDERHHALLDLDKRLRPNGAPHAHTWLYTLRARSLDEPLQPDELGRALYHLAQRRGFKSGRKAAFDPEEEKEEGKVKSGIETLRNEMAASGARTLAEHFSRIDPTAADNRIRARWTAREMYENEFNRICEAQRPHHPDILTDAFVGELRDALFFQRPLKKIQPGYCELIPQERRAPKAHPAAQRIRMVQVVNNLALRPKFGLDVELTPEQRRTLIEALEADGDLTMARARKLIGADRTMRFNLEAGGEKRLVGDRTGAAMRLAIGARWNSMTSEQREGLVLDLLRGPEDPGAMALELTQRWGLSPEEAQRAATAKLEPGYSPLSLEAIRALLPRIEAGERFAAARHAVYGEKLLEGPAHDLLPPLRRHGGVRERDVFPALRNPAVERSLAELRKVVNCLIRKYGKPERIHLEVARDLKNPRDRRVKINQRRLKNERARTAAFEKIRAETGDPRPNRSEIEKYLLWEECAGICPYTGESISLRNLFGPESQFEVEHIIPRSRSLDNSFNNKTLSHRDANREKRNKTPWEAFAHDPERWQQILQRVRRFTGDSARAKLRRFEETEVKLDDFTERQLNDTRYASRLAGDYLGLLYGGRVDKDGRKRIQASAGGLTALLRAAWDLNGILDDGPTTNGGAKIKTREDHRHHAVDAAVIALTDESTIQRVARASAAAAAEQRRRIDLPTPWSNFVDDVRQVIADIVVSHRVDRRVQGKIHDDTLYSRAFQRKKNGKLVEVRRVRKRLDAMTAGEIEKIVDPGVRRVVQQQLERIGGDPKKFADRSNLPHLPNKNGPPVPIRSARIERVQSVRTLGRGPSERHVALAANHHLEVYAVLDEQGEEKRWEGRLVSLYEAMSRARAARRGEETLPVVQRDHGPETRFKFSLTGNDVIDLEEDDEVRQLYRIRSINQEQAKTGRQPSPRVEFCDLADAREVKPMKKAGRYFKPAVNSLKGRRCYKVIVSPIGEVFPAHD

SEQ ID NO: 7405 - protein, 1036 aa, unidentified
  REGION 1..1036: note = Description of Unknown:uncultivated organism sequence
MGHSYLLSLDLGIASIGWALLGLDDHGNPNRIIRLGTHLFEAGSSESDFERGKDEPPAKPRRDARQLRKMTWRRARRKRKLLRQLQLANLLPPGDVSNPAAIDTYTKSIDAELAKTWNANVSHREHQLLPYRLRAAGLDRDLSPVEFGRALYHLAQRRGFLSNRKSKEKPDEAGAVKQGISDLAKEMQAKGSRTLGEYFSSIDPEQVKLRRRWTSRAMFAAEFDQLWSRQAAALKLTAEQRGVIHDAIFFQRPLKPMDHLIGRCRHMPQHRRAPMACRLVQRFRMVQKVNDLFLVDEYANRTPLTPEQRALVLKELEQTNTVAMTTLRKLIKGKKGLKFNFEYEGDKSLPGLKTDVRLSEVLPEYATWADDKKDAFVDELIGKLDDDKLRERLRDGYKLSPAAVDAVLDTGLEDDHAGLSRAAIRVLLPRMEQGENYMVVARELFPDEFKPVKPVDRLPPILKHDRELRNPTVLRGLTEVRKLVNLIIKRYGKPQRIHIELLRQLKQSRDARADASRDNDARRKLREKAAEEIVRQVKVPRANGRDIEKWLLAEECGWECPYTGKTINVHSLFVEPQFEIEHIYPYSRSLDDSFANKTLCHREANGEKLNKLPSEAFSPDRLAEIVDRVAHFRSDARDAKLKRFKATEIPEGFTNRQLTDSSHLARSASQYLGLLYGGINDETGTKRIHTRVGGLTAQLRRLWGLNQILSGTDEKTREDHRHHALDAVVVGCADTRTVQEMMRVASAQIAWGRSRISELPLPFDGFFDQLVDSINTVIVSHRQSRKIGGKLHAESNYSRAKTIDKEKTRTIRKPVTSLKETDFAKIVDPRIRAAVEAAFAASGAKSPDKAFAEGKFPRWLAADGSSTPIKRVRITTDARPFTVGKHNRERHVNSTQGSNHHARIIATLDKDGNEKSWRDEIVTRFEMYHRRANGTLAADAALRENERFKFSLAANEFVEIDDLDPDGKVVGRMLCRVLSISKGDIELVHHLDGRPSTARSTVEKGRLRARSMAWFKDRNANKVFINYLGEVKGAGG

SEQ ID NO: 7406 - protein, 1077 aa, unidentified
  REGION 1..1077: note = Description of Unknown:uncultivated organism sequence
MGTAYLLALDLGIASIGWALLALDDNDHPCRVIRVGTHLFDSGNVAEFERGKDEPPAKPRRDARQLRKMIWRRARRKRKLLRLLQQTGLMPPGNVSTPAAIDAYLKGIDAQLAQVWNLGADHRQHQLLPYRLRAAGLDRDVSPIEFGRALYHLAQRRGFLSNRKSKEKPDEKSEVKQDISYLAAEMAAKGSRTLGEYFASIDPEQVRLRRRWTSRAMYAEEFCQLWARQHAVHGLTLDDQKSICDSIFRQRPLKSSAHLIGRCQHLPANRRAPMGCRLFQRFRVLQKVNDLCLNAGVTVDKPVIGKDRQPVINEKTGQPKVKKEWVATGERQALTSAQRQTVLDGLSAEESVTLAELRRRINAPRGMKFNFETGDDVETSFPGMKTDVRLAKAVPGYAQWPEDRKTAFVDELLGSLDDAPLRDRLAEAYKLDDAAIDAAFDAGVEDDYGSVSRAAIRRLLPHLEQGLPYATARKIEFGDNEERRADAMDRLPPVLKCLPELRNPTVLRGLTEVRKLVNLVVKRYGKPRRVHIELLRELRKPRKVRAEIAFDNDQRQKRRKLAADELIRQTGFPRASARDVEKWLLADECGWICPYTGKSINVHNLFLEPQFEVEHIWPMARSLDDSFANKTLCHLDANRDKSNRLPVEAFTTDRLAEIAGRVSRFHGDLRDEKLRRFRATEIPEGFTNRQLTDSSYFARAASQYLGLLYGGVNDPAGADGTPGTKRIHTRVGGLTAQLRRLWGLNQLLSGTDEKTREDHRHHAIDAAVVGCADTRTVQEMMRVASEQIHFGRSRISNLPLPWAGFVHELGDALDTVVVSHRQSRKVAGALHAETFYSRVKHIGNRETRTIRKSVTALKEGDFAKIVDQRIRNAVEAAYARSGARSPEIAFADGNYPRWTSKDGGSQVIKRVRITTDVRPRAIGGSERARFVDSTQGSNHHARIIATLAPDGTEKAWRDEIVTRFEMYRRKAADTRLSPWVDRTVGSNERFKFSLASNEYVEIDEWDASRRPTGQRLVYRVLGVSDGNFEICHQCDGRTVRQRRDARARKTTSGVDLFKRNARKVFVNYLGEIKDAGG

SEQ ID NO: 7407 - protein, 1008 aa, unidentified
  REGION 1..1008: note = Description of Unknown:uncultivated organism sequence
MKGGSSCRIPQLTHISDFNFGIGVNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRRRWTSRDMYEKEFNAIWDAQAPHHADLLTPERKKQIYDTIFFQRPLWLDPGTVGNCELEPGEKRAPAYLLVSQRFRLLQTVNHLRVLPPDDVDMPLTPTDRKKLVDALETKGDLTFKEISKLLKLEKGYKFNLESGGEKRIKGNRTNAAFYAAFGERWLAMSPEERDRAVEYVHSFQKAEKLKDAARRKYDLTEEQAEQLAGISLEADYMNLSRKAIEKFLPLLEEGVTYGEARKKLYPESFEAREAMPMLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPKRYQAVLDRVRKLAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAPLEHRRRFASLEAPWPNFVDSVRTEIDRIIVSHRVSKKVSGALHEETFYSAPRADGTVHVRRSISANVRSTRQISKSELDDIVDDRVREAVKAKLDELGGDLKKFADERNLPCLLTRNGSRVPIRKARIRRARPVFSLDRVRHVSTDSNHHVELIATLDAHGNEAEWQGRVVPMRDAYLRVRLHAPVIDRTCDPSEEYKFSLCPGEVIECWRGDGPELLVYKGVSQYTAGQVVISLLPLNEAGKNPKLIRVVPNRLRQWHARKVVVSPIGEVTEAHD

SEQ ID NO: 7408 - protein, 1069 aa, unidentified
  REGION 1..1069: note = Description of Unknown:uncultivated organism sequence
MSSRENGAFVLGIDLGASSVGWALIERIDDVPAHLVRAGARVFDAAVGGKPGALEAGREKSPGKARRDARSQRRQTWRRSRRLRRVFRLLQRWGLLPAGPLAERQRILDELDRRIVSSAWFAAKRKDSAIPEPFQVLPYLLRAAALEEKLERHFLGRAFYHLAQRRGYRSNRIDLAGDKKDEERGKVEPAIAGLRMEMAQGDTRTLGQHFSRQAPAEKRIRQRYTARDMYEHEFEAIWNAQQGHYAEELTTERKRQLHKAIFFQRPLRSSRHLVGFCELEKGKRRAAAALLISQEFRLLQKVNDLRVGLPGEAERELTAAERQALIERLQSEGDQKFSAIRKLLRMPAKERFNLERGGETKLPGNQTNAALRKELGARWDAMRGEERDKVVAYLRSFQKQEKLAAALARKFGFDEETAKRVAEISLEPGYMSFSQAALKKLLPLMREGRALAEARKELYPEKSAEARDVLPPVVMAGKELGSIKNPAVVRALTELRKVVNAIIRTYGRPAEIRIELARDLRNSRVQRERMAKSYRENEKQRSEAAKRILKETGNAHPSRDDIQRALLWEECGGICPYTGKAIPFHALFGRDAAFDVEHILPLSRSLDSSFANLTLCDAEHNRHVKRKQAPWEAYSGDAAAYEAILDRVKRFQGGYAEEKLRRFRMTTEEIATFLEDFTERQLNDTRYATRVAADYLGLLYGGRVDGEGKRRVKTTAGQVTAILRNEWKLNEILNDGPTANGGEKAKTRDDHRHHAIDAIVTALTDDGSIQALSRAAENAAEFRRRRFAPVAEPWPNFLEDVQKEIQRMVVSHREHRRARGALHEETIYSHPIGRGGEQRGKRGKGRSEEFRVRKPLSSLKATEVGRIADDAVRKLVGAKLEGFPGQEPSRVFSNAENLPYFETKDGLRIPIKKARLRTDLKHPVVLGSGGAARHVKSEANHHAEVFAEVNERGQVTGWDCEVVSLLEAVRKKQAREPIVRKEGSEGREFLFSLAPGDILEMDGQGGTRELAVIRAISQEPRIAYVSVRDARKKSEMEAAYVRKTPNALFKLNARKVRVSPLGDVSEAHD

SEQ ID NO: 7409 - protein, 1086 aa, unidentified
  REGION 1..1086: note = Description of Unknown:uncultivated organism sequence
MKQYELGLDLGVQSIGWSIKIGNKIQKMGVHCFDSGTGTSEDISSGKDESRNAVRQTARSLRRQVQRRSQRAVNVARVLQQCELLPQFDEKNVKYNPAVPEDRDRLIKDLDWELFAKFINEGDRVEAHLLPYLLRARALDKKLEAYEFGRALYHLAKRRGYLSNRKAVKETDSEEDEGKVAQGISEIESEMKKKKARTLGEYFAALDPEETRIRQRYTSRQMYLDEFEAIWNKQAKFNKNLTDEAKALIHHAIFFQRPLKSMRSKLGKCELETDKRRAPVACMEFQRFRYWQKLIDLSWRAPDGDWTPLTSEQLAALADALEQNEGLTFTEIKTLLGLKKNVKINLAEGGEKKIKGNVTAARLQNAIPSRWKKMNQEQQDALVAEILQFEREDALARRLMKAFNFNATEAETVAATFLENGWASYSKAALNKILPYMIENRAPLSTAVKALYNTQKKQQEIYPLLPPLENILGDLRNPVVARTLSELRKVVNSIIRHAQKLGRGDESGKPKRIFIELGRDMKKSRKERERSFKQNRANETSRAAAKKKIIQEAGIADPKPNDILKVLLAEESNWQCPYTGKTITMKTLFGMHPQFDIEHILPFSRSLDNSYTNKTLCDAKFNRDVKRNQTPFECASGNPDEYHKMLERVKRFSNSNSSGRGGNPKLRRFLMEAIPSDFSSRMLNDTRYISRQACEYLGALYGGQIDRSENESEEDVGERKIFVCTGQATAWLRREWNLNSILNDGDEKNRTDHRHHAIDAVAIVYCAPGIVQRLARAAEESERLNDKRRLFLKGEVETPYSEFLNDIRNKTDSIHVSYRCNRKISGALHKETNYSKEHLDIVEKESKSGTAAQSKKSAQEKPVEYRYLRKPLASMSNNDIDNIVDPAIRKLVQDKLARLGGNAKAFSDPKELPYRMVKSPDGSERLVPIKKARFRQIISTKKIGNGVNSRYVATGGNHHMEVYAELDAAGREIKWVADTVTLFDAYERKIKRLPVINRDHGPNTVYKFTLFKNEFLEITNSDGSTTLKRVFKFSGQRVGFGDHNDARPANDVTDKTPGNYPSINSLRGKAQKVSVDLWGDIHPAND

SEQ ID NO: 7410 - protein, 1074 aa, unidentified
  REGION 1..1074: note = Description of Unknown:uncultivated organism sequence
MTVSEKFPYILGLDIGVQSVGWAIIPTDGGPDAVTTDPDLVKKCIRCGVRCFDGGADCGKKQWEDGFARGLDKSSNLTRRTARQIRRGFWRRRRRIAKLFSLLQEYGLLPSPGKKTAEERQKLIQRQVDPVLASQYLPQNHRIADHLLPYILRREALNQKLELIAFGRALLHLAQRRGFLSNRKTQVREDENEGKVKTGISELQQQMEECGARTLGEYFASIDPTEHRIRGRYTSREMYKKEFEMIWKKQAEYHPEVLTESLHRKIYAAIFWQRPLKSQKHTIGLCGLESGRRRAQLASIPVQRFRLWQKILDMRICDGCGESRELTHEEQDRIAGELEVCGRLPFSKIRKILNLKKGFHLNYEEEEETGDRKRGLVGNTTMAQIYTCFTDAGQQVLWNTLTDIRKQQIAEEILQFENTEALAQRLRKVFEFDTHLAQTLSRITVEQGYTLLSLAAIRKILPLMVEKRIPFASARKEIYGEQIAIECKRTDGVHELLPPVLKTLSELRNPVVLRALTEVRKVVNAIVRRFGKPAFIHVELARDMKRSRKERQKIQKKMTDREKERETARRAIQERMKFPEVHSGDIEKYLLAEECRWTCPYTGKTITMENLFGSHPGFDIEHIIPYSRSFDNSFSNKTLCDSGENRMKKKNRTPCESYSSDPERWHGILVRLQGFRGPYAKIKLERFLQEKTDEDFSNRMLSDTRFISRKAGEYLSVLYGGLWDSGGTRRIQVNTGGITAILRRAWDLNSILNPGNTGKTREDHRHHAVDAAVIACCNASVVMKLSSASEEQSRKGNRPDAIRIDPPVREFRNILETVIRKIIVSHRCDRSVSGAFHQETFYGLVPGNGEEPGGKKKESSMVRVRKPLATLSRNEVEKIADPHIRERVTGVLGENDPKKFFQNEDNLPFLESRDGRKIPIRRVTLLVPMTVRTIGKGIRERHVVLGENHHMELFFKKEGKKEVPDGDPVSMFEAYQREKRGEPIVKRDHGPGTRFLCSLHKRECLEIYDPENQEVRLYVISTIKSNKQIFYQLHSDAVPAASKKGLSVTPETFVKKGVRKVYVDVLGEIHPAND

SEQ ID NO: 7411 - protein, 1069 aa, unidentified
  REGION 1..1069: note = Description of Unknown:uncultivated organism sequence
MSSRENGAFVLGIDLGASSVGWALIERIDDVPARLVRAGARVFDAAVGGKPGALEAGREKSPGKARRDARSQRRQTWRRSRRLRRVFRLLQRWGLLPAGPLAERQRILDELDRRIVSSAWFAAKRKDSAIPEPFQVLPYLLRAAALEEKLERHFLGRAFYHLAQRRGYRSNRIDLAGDKKDEERGKVEPAIAGLRTEMAQGDTRTLGQHFSRQAPAEKRIRQRYTARDMYEHEFEAIWNAQQGHYAEELTTERKRQLQKAIFFQRPLRSSRHLVGFCELEKGKRRAAAALLISQEFRLLQKVNDLRVGLPGEAERELTAAERQALIERLQSEGDQKFSAIRKLLRMPAKERFNLERGGETKLPGNQTNAALRKELGARWDAMRGEERDKVVAYLRSFQKQEKLAAALARKFGFDEETAKRVAEISLEPGYMSFSQAALKKLLPLMREGRALAEARKELYPEKSAEARDVLPPVVMAGKELGSIKNPAVVRALTELRKVVNAIIRTYGRPAEIRIELARDLRNSRVQRERMAKSYRENEKQRSEAAKRILKETGNAHPSRDDIQRALLWEECGGICPYTGKAIPFHALFGRDAAFDVEHILPLSRSLDSSFANLTLCDAEHNRHVKRKQAPWEAYSGDAEAYEAILERVKKFRGKYAEEKLRRFRMTTEEIATFLEDFTERQLNDTRYATRVAADYLGLLYGGRVDGEGKRRVKTTAGRVTAILRDEWKLNEILNDGPTANGGEKAKTRDDHRHHAIDAIVTALTDDGSIQALSRAAENAAEFRRRRFAPVAEPWPNFLEDVRKEIQRMVVSHREHRRARGALHEETIYSHPIGRGGEQRGKRGKGRGEEFRVRKPLSELEATGIRRIADDAVRKLVEAKLEHFPGAKPGRVFSNAENLPYFETKDGLRIPIKKARLRTDLKHPVVLGSGGAARHVKSEANHHAEVFAEVNERGQVTGWDCEVVSLLEAVRRKQAREPIVKKEGSEGREFLFSLAQGDILEMDGQGGTRELAVIRAISQEPRIAYVSVRDARKKSEMEAAYVRKPPNALFKLNARKVRVSPLGDVSEAHD

SEQ ID NO: 7412 - protein, 1035 aa, unidentified
  REGION 1..1035: note = Description of Unknown:uncultivated organism sequence
MTERTNNLTLGLDLGSNSLGWALIENEDNGQKRIIDKGVRIFEAGLDNLEQDGRGESRNAARRDARSSRRRLERLSRRLVKLAGILQENGFLPEGNIGDPSKRNGLFTELDRKLDNPYKLRAKGLDNKLEPFEFGRAMYHICQRRGFLSNRKELPKKKEEEGKVKAEIGELQKKIDESGARTLGEYFSKVNPHEERIRTWYTSRRMYEDEFNRLWDSQKNYYLNILTDDLKKQAHHAIFFQRALKSQKNLVGKCEYERTQRRAAWAILDAQEFRYLQRINDLEIILNNERRLLSPDERVKLINELERNSSLKFSSTRKATLTIKKILELPKSASFNLEKGGEENLHGNKTATTLREIFKDRWDEFSRKDKDQIVEDILSIQNSDALARRGTKKWGLDEEAAKKFGNISLQSGYCSFSRKALLKILPKLREGFRLNEILREAYPDRWEMQSEPRDILPPVKNEDIPEIRNPIVERTLSELRKVVNAVIKKHGKPESIRIELARDLRQNAKQRERTFKSMRENEKQRKSAAEEILKECGLANPSRNDILKFILWKECSGHCPYTDNYIGPSDLFSSQPNFDIEHIIPFKRSLDDSFMNKTLSHVATNRNIKKDMTPYEAFSSRPEWDDIISRVKKFNNQEKLKRFKMTEKEVEEFLSDFSSRQLNDTRYATKRAKEYLGLLYGGLKEDAAQGTEKVQAVGGQITAYLRNVWGLNSILKDGPGKSRDDHRHHVVDAIVIALTEQRWVNELSNAAKNAPKAGKRRFAAVMPPWNGFWDDVKNSVSSVIPSHQITKKVKGALHAETFYGRPYKDGKGKQFTKTRVALEKLTPKNVENIVDKIVKQKVKDKLKELGKAPKEAFKNPDKNSNLPLIKTKTGKEIRIKKVRIEMPFETHLRVGEGYRERYVRSCPDSNHHMEIYKDLATGRWDGEVVSLFKAHQRLRSKQPIIRKHHGEEKKFLFSLAGGETIELDTEDGKRGLFVVRTVPQSKQIVFVPINDSRKRKDIGTTGLTAYPESLKERHCAKVLITPLGEVRRASD

SEQ ID NO: 7413 - protein, 1035 aa, unidentified
  REGION 1..1035: note = Description of Unknown:uncultivated organism sequence
MTERTNNLTLGLDLGSNSLGWALIENEDNGQKRIIDKGVRIFEAGLDNLEQDGRGESRNAARRDARSSRRRLERLSRRLVKLAGILQENGFLPEGNIGDPSKRNGLFTELDRKLDNPYKLRAKGLDNKLEPFEFGRAMYHICQRRGFLSNRKELPKKKEEEGKVKAEIGELQKKIDESGARTLGEYFSKVNPHEERIRTWYTSRRMYEDEFNRLWDSQKNYYLNILTDDLKKQAHHAIFFQRALKSQKNLVGKCEYERTQRRAAWAILDAQEFRYLQRINDLEIILNNERRLLSPDERVKLINELERNSSLKFSSTRKATLTIKKILELPKSASFNLEKGGEENLHGNKTATTLREIFKDRWDEFSRKDKDQIVEDILSIQNSDALARRGTKKWGLDEEAAKKFGNISLQSGYCSFSRKALLKILPKLREGFRLNEILREAYPDRWEMQSEPRDILPPVKNEDIPEIRNPIVERTLSELRKVVNAVIKKHGKPESIRIELARDLRQNAKQRERTFKSMRENEKQRKSAAEEILKECGLANPSRNDILKFILWKECSGHCPYTDNYIGPSDLFSSQPNFDIEHIIPFKRSLDDSFMNKTLSHVATNRNIKKDMTPYEAFSSRPEWDDIISRVKKFNNQEKLKRFKMTEKEVEEFLSDFSSRQLNDTRYATKRAKEYLGLLYGGLKEDAAQGTEKVQAVGGQITAYLRNVWGLNSILKDGPGKSRDDHRHHVVDAIVIALTEQRWVNELSNAAKNAPKAGKRRFAAVMPPWNGFWDDVKNSVSSVIPSHQITKKVKGALHAETFYGRPYKDGKGKQFTKTRVALEKLTPKNVENIVDKIVKQKVKDKLKELGKAPKEAFKNPDKNSNLPLIKTKTGKEIRIKKVRIEMPFETHLRVGEGYRERYVRSCPDSNHHMEIYKDLTTGRWDGEVVSLFKAHQRLRSKQPIIRKHHGEEKKFLFSLAGGETIELDTEDGKRGLFVVRTVPQSKQIVFVPINDSRKRKDIGTTGLTAYPESLKERHCAKVLITPLGEVRRASD

SEQ ID NO: 7414 - protein, 1035 aa, unidentified
  REGION 1..1035: note = Description of Unknown:uncultivated organism sequence
MTERTNNLTLGLDLGSNSLGWALIENEDNGQKRIIDKGVRIFEAGLDNLEQDGRGESRNAARRDARSSRRRLERLSRRLVKLAGILQENGFLPEGNIGDPSKRNGLFTELDRKLDNPYKLRAKGLDNKLEPFEFGRAMYHICQRRGFLSNRKELPKKKEEEGKVKAEIGELQKKIDESGARTLGEYFSKVNPHEERIRTWYTSRRMYEDEFNRLWDSQKNYYLNILTDDLKKQAHHAIFFQRALKSQKNLVGKCEYERTQRRAAWAILDAQEFRYLQRINDLEIILNNERRLLSPDERVKLINELERNSSLKFSSTRKATLTIKKILELPKSASFNLEKGGEENLHGNKTATTLREIFKDRWDEFSRKDKDQIVEDILSIQNSDALARRGTKKWGLDEEAAKKFGNISLQSGYCSFSRKALLKILPKLREGFRLNEILREAYPDRWEMQSEPRDILPPVKNEDIPEIRNPIVERTLSELRKVVNAVIKKHGKPESIRIELARDLRQNAKQRERTFKSMRENEKQRKSAAEEILKECGLANPSRNDILKFILWKECSGHCPYTDNYIGPSDLFSSQPNFDIEHIIPFKRSLDDSFMNKTLSHVATNRNIKKDMTPYEAFSSRPEWDDIISRVKKFNNQEKLKRFKMTGKEVEEFLSDFSSRQLNDTRYATKRAKEYLGLLYGGLKEDAAQGTEKVQAVGGQITAYLRNVWGLNSILKDGPGKSRDDHRHHVVDAIVIALTEQRWVNELSNAAKNAPKAGKRRFAAVMPPWNGFWDDVKNSVSSVIPSHQITKKVKGALHAETFYGRPYKDGKGKQFTKTRVALEKLTPKNVENIVDKIVKQKVKDKLKELGKAPKEAFKNPDKNSNLPLIKTKTGKEIRIKKVRIEMPFETHLRVGEGYRERYVRSCPDSNHHMEIYKDLTTGRWDGEVVSLFKAHQRLRSKQPIIRKHHGEEKKFLFSLAGGETIELDTEDGKRGLFVVRTVPQSKQIVFVPINDSRKRKDIGTTGLTAYPESLKERHCAKVLITPLGEVRRASD

SEQ ID NO: 7415 - protein, 1045 aa, unidentified
  REGION 1..1045: note = Description of Unknown:uncultivated organism sequence
MTGQDTERVLGLDLGANSIGWALVEYEKGEPARLLAMGVRVFEAGVEGDITQGKDESRAAVRRAARLMRRQTDRRARRLKKLAGLLQGHGLLPPGNVGSELERDMLIKNLDKELYRSYVTRLERRDGLAQLPYFLRARALDHPLEPYELGRALYHLAQRRGFKSNRRDTGKKEEDLGAVKKGIADLEQQMAESGARTLGQFFARLDPHEQRIRSRWTSRQMYEQEFASIWEVQSAFHPEVLTETLREDICEAIFFQRQLRSAKGLVGQCSLEPGHRRAPWTALDAQRFRLLQRVNDLRIICPDYAERQLTPQEREVVLALLDRERKVKFTQLRKVLKLGKGYSFNLERGGEEWLVGNTLAAEMRKAFGDRWDVMSQEEKERVIHDVRSIQKDDVLERRGRDVWGLDEEHAKRLASIALEEGYCGLSHKALQNLLPLMEQGMAYAEARRKVYPQSFGAGCSTEFLPYVDDRDAVPFELRNPAVHRVLTELRKIVNGLITKYGKPDKIRLELARDLKRSRKDRELLSKKNRKNEEKREAAKKKIEDEMGVEKPSKEDILRVMLAEECRWQCPYSGKHITMSQLLGDASQFDIEHIIPYSRCLDDSYTNKTLCYHEVNRTRKKNRTPYEAFAGTPEWDEIIQRVKQFQGEAEVVRAKLRRFLAEKIDEFEDYAARQLNDTRYASTLAAQYLGLLYGGMTDSSGVRRIQAGRGEITADLRRAWGLNKILGDGDEKRRNDHRHHAIDAVAIALTDHRTVKALSQANERAGREGRRSWWKDIPLPWNGFLEEVQNAIETLVVSHRPIHKVGGPLHEETYYSKPYEGEDGKTYVHVRKAIDALSGNEVEAIVDPTVRERVKSRLEELGEKEPKNAFKDPLQHPYLETRDGRKVYIHRVRIRKVMTPFAVGEAPHRRRYVVAKENHHMEIFETTNKRGEVKWEDRIIDQFEAVRRLRRGEPVVRRDYGDGKRFVMSLAVGDTVMLLKEQKESLWIVRSIWKGRVSLSPCNDARKQADLKKSGVFNSPAIDSLRNWNCRKVVVTPLGEIRWAND

SEQ ID NO: 7416 - protein, 1066 aa, unidentified
  REGION 1..1066: note = Description of Unknown:uncultivated organism sequence
MAHGSGGYRLGIDLGTNSVGWAIVGGNRIIAMGSRIFDAGVQGDIEKGKEEPRNAQRRQARQVRRQSERRARRLRKVYNLLGRHGLLPPAGDPQQRHDLLLQLDATLRSKSPKNRASPHADAQTWLYGLRARGLDEKLEPDELGRALFHLAQRRGFKSGRKAAYTPEEQEDEGKVQAGIETLRERMATAGARTLGEYFSSLDPTEREQRIRGLWTARDMYAHEFDEICKAQNAHQPELLSDALVADLREAMFFQRPLKKVLPGRCELEPDQRRAPLAHPAAQRIRMIQAVNNLALRPALGRDIDLTQDQRNAILHMLEAHGDVTMARARRLIGVGNKMKFNLEEGGEKRLVGDRTAQHMRQAIGELWDSLTPSRQERIVTELLEADDDIPALSLGLAQRWGLERDQALALARTKLEPGYAALSLKAIRKLSPCVEAGERFGAARAKVYGASAHAGPAVDLLPPVRRHRGVREDDVFAALRNPAVERSLAELRKVVNCLLRKYGKPDRVHVEVARDLKNPRDLRARLNKRRLDNEKTRAKAFAQIQKETGNPRPNRKEIEAYLLWEECGGFCPYTGFSISLRDLFGPEPQFEVEHIIPRSRSLDDSFNNKTLCHRDANRDKRNKTPWEAFGSDPVRWEEILQRVRRFKGLSARSKLSRFESPEVQLDDFTERQLNDTRYASKLAGDYLGLLFGGRVDPGNKKRVQVSAGGLTARLRAEWGLNGLLDDGDTKNGGRDIKTRDDHRHHAVDALVIALTEERTIQQMARAAERAEEQHRRRLDLAAPWPNFVQHVREAVDQIVVSHRVDRRVQAKIHDDTLYSKAYQRTRKGKPVEMRRVRKPLENMSPKEIGSIVDPAVRAAVAAKLEELGGDVKKFHDPSNLPSLPNKKGGRTPIRSARIERAQSVQTIGKGPRERHVALAANHHLEVYANLDDDGDEMRWQGRLVSMYEAMARVRARKIGSDVAVVEKDHGKRTKFKFSLAPGETIELQEPQGEPRLYIVRSISQERTSGGRRPAPIVEFVDVRDARLKKDIKTANAWGKRAVNPLGELGCRKVLVSPVGEVFPAHD

SEQ ID NO: 7417 - protein, 1067 aa, unidentified
  REGION 1..1067: note = Description of Unknown:uncultivated organism sequence
MKSEERVPYVLGLDIGANSVGWAALRLDGHGKPCGVLRLGARVFDAGVEGDIESGRDVSRGQKRREARQVRRHFDRLGRRLQKVFGILQRAGLLPPSPPADEGMKSRDRKACARHIILTTLHVEQLARWTARLQNANASPESVESLAHVLPYHLRTRALDERLEPFDLGRALYHLAQRRGFLSNRKSTRKKDEDGVVKKGIAEIEAEMNAAGVRTLGEFFSRLRPHDPAQKRIRGRWTARSMYEKEFDLIWQAQKQHHPALLNDILYKRLRYAMFYQRPLKSQKMLIGTCELEPGRKRAPVALLVAQQFRYLQKVNDMEVFAPGRRDGEALTGEQREELVKALENEGDLTLKKVRKLIGVPPNARLNFETGGEDKIPGNRTAAKMRAVLGERWEKFTDDEKDAAVDEWLGTQKESALKGRAIKLWALSDEAASAFAALELEDGHSFLSRRALEKLVPELEKGTRYATARKELYGGPSGGKSLDELPQVEKTLPALRNPAVARALTELRKVVNALVREHGKPDFVRIELARDLKKSRKDREEISKKNRVNEKGRRTAADRIAREAGIPAPKRSDVLKVLLADECDWTCPYTGRHFGMAELLGEHPQFDIEHIIPFDRSLDDSYMNKTLCYMEENRAVKRNKTPFEAYGSDPRRWEEMLQRVRAFNGSAARAKLERFQLESLESLEDFTTRQLNDTRYASRLAGDYLGALFGGQVDANHARRVQVSKGGVTGFLRDEYNLNTILSETPDKSRDDHRHHAVDAVAIGLADASTVAMLSEAAKRALVERRRKFGRILPPWHGFFAEVAEKVGEAVVSHRVSRKVSGALHEETLYSPPKKDEKGRVVVHIRKSVDGLTKGEIESIADPVVKERVIAKLKELGTSDTKVFSNPLNLPCIVREDGRKTPIRKVRLSKVLSPISVGAGPRKRFVRPGANHHVEIVETKDKKGRLKWEGSVVSMFEATRRLKAKEPVVKREDGEGRKFLFSLAQRDTVLMKDLGDEKELFLVTGISQYQQGPIVITLRRNCDARKDKVGKGEQDEIHAYRTPDSLRKSAGEKAIITPLGEVRRAND

SEQ ID NO: 7418 - protein, 1028 aa, unidentified
  REGION 1..1028: note = Description of Unknown:uncultivated organism sequence
MTMPLEYTLGLDLGAASIGWAAIQTSAGNPARLLRAGVRVFEPGVEGDLEHGRAEPRNRARRAARQARRLTDRTRRRIRKVFHILQRASLLPPGEPHEVIPALDRESFKRYREAMPDRAQKHRLAQVLPLWLRAQALNAALPPDELGRAIFHLAHRRGFLSSRRTQPKEGEDQGQLKREIGELDQAIKASHARTLGEYLATLDPEEARIRTRKTSRAMYREEFQAILETQRQFHPQLLTDDLRTRLEDAIFFQRPLKSVAHLIGTCELQPTRRRAPWALLEAQRFRMLQMVNNTRLVDLRTGEERPLAPEERATLLAHLDRHAALSFAEAKRLIGRKPAELRFNLEQGGETRFIGNRTAAALAGVFGESWWTLSADEQRQVVTDVLTIDSEPALARRGRNHWRLSGAAADAFAVVRLEPGYCSFSRAALAKLMPYMEGGMSTSEACDAAYPERRALRQPLDALPPVTGSLKGLRNPVVARVLTELRKVVNALVRQYGKPARIRIELARDVKRSNRARAEASKRMRMQESRRAHAMERLRNEAGIGEPSRTDIEKMLLWEECGGHCPYTGRSISFAALFGADPQFDVEHIIPFHRSFDNSFVNKTLCYVDENRRVKCNRTPWEAFGHRPEYAEILDRVRAFRGDKAREKLRRFQLQEIESLDDFTTRELNDTRWAARLAADYVSALFGGRVDEGGSLRVQVTSGQLTAYLRGALELHGLLSQGDVKSRADHRHHAVDAIVVALTTPDLVRRLAETAEKTWAQRRRLFSSIEPPWPDFRSSVGAALAPMIVSHHPDRRVRGALHEETLYGRGPSGAAVVRKAVHLLRPKDMDRIVDEKVGAVVQAKAAAVGGPQRLESDPPLLGRTPIRKVRIARNERVVGIGEGRRHRLVIEGSNHHIEILAELDQGGEERRWFGRVVSTLEANRRLRARPLEAIVDRGCGPGQRFKFSLCRGDALLLRQDEHERLWLVQKISVNQRGATHIVLKPPADARPVREIPTHGRIHSPNTLFRHSARKVTVDPLGTLRDARD

SEQ ID NO: 7419 - protein, 1063 aa, unidentified
  REGION 1..1063: note = Description of Unknown:uncultivated organism sequence
MNEKNVEKILGLDLGANSVGWALIEYVDGTPQRIVGMGSRIFDAAVEGDLEKGQEESRAVERRMARQLRRQHKRRVMRMIRVGELLQQAGWLPAGNLRDSVERDRLFKELDKALREQYAIRGFKPSDTDAIRGIAYFLRARALDEPLQPYALGRALYHLAARRGFLSNRKATAKKDEDLGEVKKGITELKKQIEEKGARTLGEYFYHHVDPVKEKRIRKRWTAREMYQDEFDQILARQVELGAIQDNPKFFRKLRKAIFRQRPLKSQRGLIGPCQFEEKEKRAPWHSLLAQEFRLLQKINDLKLISPNYEERSLTDEERKVLYDLLMEEESVSFADLGKRLGFKPKDGWRFNLEAGKETKLKGNEVAARLIKVFGRDRWLIMSDREKYQLISELNSDITDKTLRRRAVEVWGLNDPEKVDVLVKMSLPAGYCALSRKALKKLVPLMRAGMPYETAVRETYGDLRFKKQTFDRLPPFLKIDHTLRSPVVIRTLSETRKVVNEIIRVFGRPDRIHLELAREMKQSKDRRKKRASEMRDRQKQREMAIDGIQKCTGIDRHRISRRDVDKWLLAEECGWVCPYSGRPINYLNLFSSTPEFDIEHIIPYSKSLDDSFANKTLCHREWNQRKGNRTPAQAFKDTPEWEAMLQRVRSFKPLHAVNRPGSSRGGQNRVDPYVQSKLRLFQMEEIPRDFVDQKLNDTRHAAKVAKEYLELLYPPEDRSKRVKAFSGAVTAELRKCWKLNSILGDPESPDPIKNRSDHRHHAIDALVLALATQGMVQYLSNAVEKQQQCQRSIRGYQKWVDEPWPDFLNDVRNAVAAIVVSHRVDHRIQGRLHNETFYSPPRQDENGKTYHLVRKPLNGSFDAGKVEKIEDRAVREIVRKHLEAHGNDPKKAFNEPANHPRINNIPIHSVRIRDYVSPIPVGKEFCPRYVLTDSNHHMEIIEEQDRKGNPVWRAVVVSRYEAMRRKASGQPVVQRDHGEGKRFVCSIASGDTFSFQENGGTVLAIARSISDQNIEFVTINDARLKADIKKAGDWKKRSVNAFRTMCFQKVMISPVGEVYPAHD

SEQ ID NO: 7420 - protein, 1076 aa, unidentified
  REGION 1..1076: note = Description of Unknown:uncultivated organism sequence
MRSENSLEYVLGIDLGSNSLGWAIIQLVDGEPAGLVRAGVRVFDAGMEGDIESGREESRNLKRREARLHRRLLWRRGRRLRKVFNLLQRFGLLPEGDASTPDKRQGLINNLDNAIRTSEWFRERATAGRYPEPDQILPYILRASALDEPLDPHLLGRALYHLAQRRGFLSNRKAVAKKAEDVGVVKKQIGELRERMREARARTLGEYFAQLKPSEERIRCRWTARDMYEEEFEKIWAVQAAHHPDRLTVERAKLLRKAMFYQRPLWFDPATIGQCELEPGKQRAPKYLLVSQRFRLLQTVNNLKVLPPGEPERGLTPADRKKLIEELELEGDMTFKQIRKLLGLPEKPQMYEFNLERGGEKTLKGNRTNADFYKIFGKSWLEMSAAQREDAVQYVYAFQKPDKLKEAARRKWHLSEEQAEKLAAISFEPDYLNLSRQAIEKLLPLLEGGVPYGEARKKVYPESFQPREVSSSLPPVSQALPEIRNPAVMRSLTELRKVVNAVVRQFGKPVEIHLELARELKKSKKQREAISENMRRNEKARAEAAKKIMAEAGIAQPRPDDIRKYLLAEESRWECPYTGRSISMAALFGPEPQFDIEHIIPFSRSMDNSFQNLTLCYVPENRAVKGNRTPHQAYSGDPHRYEAILNRVRRFAGDRRTVAAKLKRFTMNDDELEVFLADFRNRQLNDTAYASALAAKYLGLLYGGLSDAQGNRRIYATTGQATSYFRNLWKLNQVLNDGPSSDGGAVPKSRDDHRHHAVDAVVIGLTSAAMIKRLADAAERAPREGRRRFASLEAPWPRFVETVRQEISRIIVSHRVSKKVSGALHEETIYSRPLPVAAVSSSPKSARRSETAATEVRVRKPLASLTKQEVATIADETVKKLILEKLGDAEPKKVFADEKNLPFFETADGRRIPIKRVRIRKAVPTFPLGNGPFVRHVTSESNHHLEIFAELDENGNEIEWDGCVVSMAEAYKRKKLGLPIVQRDFGPNRRFKFSLAPGEVIECDSEEGMRNLWVVRGATSENSRPRLFLVPINDARKKSEIVNAGLYWRPFLNPLRNLNARKVVVSPLGEVTEAHD

SEQ ID NO: 7421 - protein, 1043 aa, unidentified
  REGION 1..1043: note = Description of Unknown:uncultivated organism sequence
MPRAASEGLILGLDVGANSIGWALVEPSSHNIVRTGARAFDEGVEGDIESGKDESRAKARREARMRRRMLSRRARRLKKLSLILQGAGLLPAGDMSTEEARHNFFTNLDRDLFPGDRTSPDAHVLCYRLRARALDETLAPHEIGRALYHLAQRRGFLSNRKAARKDTEKEEGEVKKAIAQLAADMQAAGADTLGQFFSRLDPEQQRIRSRWTSRQMFLDEFEKIWTVQAAHHPTILAADLKKKVHRAIFFQRPLKWKRSTIADCELEKDRKCAPVALLIAQRFRFLQKVNDLEFVNTADGVVGKLTPEQRQALVAKLETQAEISFSKIRTLLKLPKTCRFNFEKEDGDDRLIGNRTAARLIKTLGEQRWAALSLEDRDRIVEDVRSIQKEEAQERRGVKAWGLQGDAATEFGRLAFEPGYCRLSRKALAKIVPRLEQGVQYATAREDLYGGQPAPQPLDALPPIESAPIPEIRNPAVQRALTELRKVVNAVIRQYGKPAQVRVELARDLKKTRDDRKDIWKKNQENRKARERAAAAIVAEFPAYQPRRSDTEKYLLAEECQWHCPYTGKTMTMASLFGPSPQFDVEHIIPFSRCLDNSFMNKTLCEISENRNRKLNRTPWEAYGADAKRWDEIMQRVGAFAGNARRAKLQRFQLKDLESLDDFAARQLNDTRYATRLAVRYLGLLYGCNLMGVAPDGRRPIQAGRGQVTGFLRDELGLNEILGDGGQKTREDHRHHAVDALAIALTDAKTVKMLSDAAARALRERRRRFGRVEPPWPSFLDDARRAIGQTIVSHRVSRKVNGPLHDQTLYSKPQKDADGQDCVHVRKRLDKGFTAAMVADIVDPVVRQRVEAHLKAHDNDPKKAFALPENHPVLETKDGRKIPIHKARIRIRQTTMPIGSGRREGRIMSGSNHHIEIFEVKDSKGRIKWDGKLVSRYEAMQRLRNRQPIVHRDHGPDKKWVFSLAGGESVQMKDPESGTPGLFVVTGISEGEITMLRNADARPSKVLRKTRGARVRPAPDTLRKLGAKKVTITPDGEVRRAND

SEQ ID NO: 7422 - protein, 1118 aa, unidentified
  REGION 1..1118: note = Description of Unknown:uncultivated organism sequence
MIEVGLDLGTNSVGWAIVVPTGGKEHVSAGSYVFPEAGEEEGGEFVSFRRKRGEKRRQRKQLRRKRQRRRSVGTLLAGAGFLPSSREEQFAVLTNLCPYAARADALDRKMEPHEFGRAIYHLAKRRGYLSTAALKLIGIPNVGELDARLARRAVERSDKEQADGEADREAIKEAKAVLDNIERTRSRLEAGEARTLGELLYKEIRQNRPVRAITGARISRPIEKAVRATLGATTWDSLKAKDRTAILDNLKKLSLLLQQGSDEAKVSETHSTLADRGLDRNTAMHLATNAVREPVLGIRGDRRMYEEEFDAIIAAQRHYYADVLTDEYVAKLREAVFLQRPLKPTSGLVGYCSILPEKKRCPMATMLSQHSVILQKLTSLNICRRDGSQRRLRPEEIHILVDALDQPPLLDLSGKKLSWDKASQLIKLGEDEHFADNPPSEGGKKPRRRKGASGLDGLPGNRTAIVMCDAIGDKWLRLPNYGNKGKSKDGLLHRILTCQKVKDIAPGLQRDFGLTDDDIYYLATAKLPDGYNKHCARILRGIEPFLRKGMVYSEALEAAGFREPNVSTEKTPENPADYAANLTNIANPVVQRAVTNALVVLNAIIKKYGKPSIVRIELPRDVARTNKQRQQVQQAQKSREKYNEAAKKALREAGLPDEDSRNVLKVRLWQEAGCRSPYMPEQELTIHQVINECDIDHIIPRSRSLDDSYLNLTIAPNQINLAKGDKTPYEAFGHDEQRWAEIKAYLNTIKSMPKSKKHRILAEKSEKTDFVGRDFSDTSYIAKKVMEAVKATGIPVEVTRGALTAELRKLWGLNEVLPLTDQERERLQSANKRGAFKSRDDHRHHALDAIVTALMNRSTYQRLTGYYKTRETHRNVPRTLAQKFELEKPWPTFVEDVARVIEAAPVVFQPTRDVGGPLHEETGRTPPSREVVEKAIAALPEHRRKKTRRAVVVGSQLVYLDENGEPLTAYDLGSNHHCIIWQSTKPDAKGRIRRELEVVTMIEAATRASCGEPVFSARHSNRGPEWKPFLFLCKNDIVEYDDPKHGRRLMRVAKFSITERSNNGIMLRPVRDAREIKENNVVVKGQDALARILRRVILSPLGDEIGSEPQYADDQPGS

SEQ ID NO: 7423 - protein, 1131 aa, unidentified
  REGION 1..1131: note = Description of Unknown:uncultivated organism sequence
MTSPPAAAEVRSHAVARNGSRLFTSGTPFALLCLATAARVRYDNNRTGQMSQVKKNGGKSMKSDKVPYVLGLDIGANSIGWAALRLGPDGNPCGLLSTEEGFPSMGVRIFKEGVDQYGGGEREETRSAQRQTARSRRRQTMRRARRLKRVFRLLQEAGLLPPFPEGAISAAGDERIARDALIKELDQKLAAKWAAHLPPEQRQVAVERLPYFLRAWALDHPLEPYELGRALYQLAQRRGFRSNRKSPPKKDERPGEVQAAIDELVRKMQEPDPNTGRPFARTLGEYFAKIDPAREPIRCRWTSRRMYQDEFEKIWAAQVAFSPRLQDLSVTVPPNKGERVPLRVALEKAIFHQRPLKSAARFIGECELEPGRKRAPRAFLDAQRFRMLQQVNDLRVHLPNSGRETPLTPEQRRILIDCLQENEELTFTQIRSLLGLPRGSKFNYERGGERKLIGNTTFARLKRIFGDRWTALKPEEQEQVVLDLWSIQKPEALERRVAAKRGVWSRLDPSSDEAKQVAEMPLEGGYLKLSRRAIAKLLPHMEAGLSFAEAKARVYPDKQAKEALEFLPPVHEVLKELRNPVVSRALTELREVVNALIQVYGKPELIRVELARDLKRNRKEREELIEQMRKNENLRKRARDALIEEGCHDPRESDITKRLLAKECGWICPYTGKPFNMEQLMSGQVEVEHIIPFSRSLDDSYMNKTLCWADENRNKAGRTPYEAYGHDPTRWAEILRRMKENVKKHGMPAEKLRRFQMNEEEVERFLRDFHQRQLNDTRYASVKAREYLTLLYGGILAQGRDREGRIRVQVGAGQVTAWLRRELGLNRILGGGEKVRDDYRHHAIDAVAIALTSPQIDPPWPSFLDDVQRAVEQIIVSHRVYRRARGPLHAETFYSRPQEYKGKTYSHVRRQLWDLEPSQIKDIVDEAVRNAVEQKLRELGQTDPRKAFNPSRSDTLPTIRCGSRMNRIRKVRIRKAIATFPIGRAVFRRYVENEENHHLEIIETRDARGRIRWEGIVVSLFEAVRRRAEGRPVVQRDHGPNKRFLFSLVKGDAIELQENGIPVLYRVTGISKDLRGVVQIEFARNSDARPKKVRGRKGLTATPDKLRKKHCVKVIITPIGQKRYIPEGSEA

SEQ ID NO: 7424 - protein, 1111 aa, unidentified
  REGION 1..1111: note = Description of Unknown:uncultivated organism sequence
MDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSGGEQKDGEDRKNKKNKKGKKSEKSERERIRAAISQLQQAMQTSGARTLGEYFARLDPHQERIRGRWTSRRIYKEEFEAIWAAQAPFHPEWTAADKDRLFRALFFQRPLKSQRGLVGLCPLESKVLPPAQPGQKAKVLYRHRRAPLASLEAQRIRYMQRINDLEIIAPDGTHWVLRDPAYQLMRSKLYDLAEHHEELTFPAIRKALGIPTGKKGEDWKFNLEAGGEKKLPGNTTAARIRRILGDQRWDSLGPDGQKQLVDTLLAFLSEEALQQHLEAHWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAEEDIVDPEVRRLVQEKLQALSQHDPKLADPKKAFASPENLPYLRSRRTGQIIPIKSVRIWVTAHLEKIGSGMRQRYVIPGTNHHLEIFAHLDAQGNETRWDGHVVSLLEAVGRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 7425 - protein, 1066 aa, unidentified
  REGION 1..1066: note = Description of Unknown:uncultivated organism sequence
MSKTDSISSYTLGIDLGSNSIGWAIVKLDENDNPCGIEKVGVRVFEAGMKGQYEEGKEESRNKKRREARLVRRQIERRARRYRKLANLLQQIKLLPQGDLNDSGERQRILDELDKVLRTKYINNHLSPEEKNRLHQIFIYYLRSLSVEQKLEPNALGRVLYHLGQRRGFLSNRRGQKKDNEEQGKVKKGIAEIRVEMSRLGTETLGKYFAQIDTMDINQKRIRGRWVARDMYEQEFYTIWDFQSQFYPELLTEEKKKQVFFAIFFQRPLKSQKDKIGFCQFECIARGKKRNRRRAPWVILKAQRFRLLQKVNDLLIVADKNTKNPLTDDERKLVIEHLEKNGDTTFTQLRSLLRLPEEVKFNLEVAGEEKIPGNRTASEIRKVIGEHWDGMNSEEKDKLVEDIYSIVSDRALKKRLMRHWKFTEEEAQKLSEIPIEDGYCNLSRQAIDKFLPGLQQGRRYGELVKEIYGMDAIREGFKVDLLPPIEEAPIGEIRNPTVQKTLSEMRKIVNEIVKLYGKPRYIRIETGKDLRNTKKERERLWKNSRDMEKERKKIKDVLMKNGIANPTRDDIERYMLAEECRWICPYTGRSIKFKSLFEESQYDIEHIIPLSRCLDDSFKNKTLCYHEENRNRKHNKTPYETYSQDETRWNEILERVSKFNSAHAKEKLKRFNLHGKTLEEFIDKFSSSQLNDTRYAAREAVIFCGLLYGSEYRKHVFAVAGPTTAVIRRMWKLNKLLGSPEKNREDHRQHAIDAIVIAITSPAMIKNISEQAEKIPKSERKHDRWWRFIQPPWDTLYNEAKEKILSIIVSHKPERKVSGRLHEETNYSPPKQGDNKDETVVHVRKAIASLSKGEVEEIVDPVVRETVKKKLEELGKENPKKAFTDLKNYPLMPNRKGLQIPIKSVRIRKKLSVFPVGSKHRVRYVATDENHHIEIFETKDKKGRIIWDANVVSMFEAMQRKRRGEEIIQRKLIRDGKVVEDAKFLFSLCKGDMVYMKDSEGEYQYYKLVIVSEYASGAKVMFFLPHHVAKIPKSWVGLTKTSSALQKSEAKKCSINVLGETHIAHD

SEQ ID NO: 7426 - protein, 1102 aa, unidentified
  REGION 1..1102: note = Description of Unknown:uncultivated organism sequence
MEQKESYILGLDLGANSIGWALLEAHPDPEEKGRLKAHGIKQIGVRIFEAGVEGEIEQGKDQSRAVDRRDARLARRRLDRISRRLSHLFYLLMSAGLLPEHPAYKTELGKKKSAKERKQERDLKAKARHEVINQLDQDLVKKWREKEPLAKETLPYILRAKALDEKLELYELGRALFHLAQRRGFLSNRKAKAKDDEELGKVNQGILELEGKIEGAGARTLGEYFSKLNPKEERIRSRWTSREMYLKEFEQIWNAQEKHYPKILTPEFKKKIWRCIFYQRPLKIQHHLIGECQYEKGKKRAPSACLAFQRFRMLQQLNNSYLISPDGEILNDGRLTNEQRERLIEVLEKKAELKFSKAKKILGLTKEYRFNFEKEDGKGEFLGNETAEKLIKVFGEERWSRFSEQEKNEIVQDLISIQHKSGLVKRGKNKWGLDDENAEEFSKINLEEGYCGLSRLALSKLIPLMETGLTYMEAVKQVYPDRLQNEAFDQLPMVINQMPELKNPVVKRVLTELRKIVNAIIRKYGKPEQIRIELAREMKKTRQQREEIWKKNKQNEEKRKQAAQAIIKEAGENPKPGDIEKYLLWDECNGICPYTGKSISLKQLFSGEVDVEHIIPYSICLDNSYFNKTLCFHDENAKVKNNKTPWQAYGSDEKKWNEILERVKRFKGDAAKEKLKKFQIKDLEELDDFISSQLNDTKYASKLAKKFLGLLYPGQEALSRVQATKGGITANLRDVFNLNSILKDGDSVERDGYEPKKTRADHRHHAIDAICIALTEPSTVKMLSEASSRALKERKRRFGKVQPPWENFWEDVKKAIDNTIVSHRVSKKVNGPLHQETFYSPPKEVQGKIICHVRKPLENLSAGDIEDIVDPVVKKKVQEKIKELGGGDPKKLFAGSSTLPPEKLPCMTAKDGRVIPIRKVRIKCVMTPFQVGDKGRERFVTSDTNHHLEIFETKDKKGNVRWDGAIVSQYEAMRRLRAGEPIVKREHGKGKEFKFSLALNECVKLLDEKGQEIVCVVKGISQLSAGPIVITLRHICDARPTSEYQKQIKMRKELKKNYDKKLAEEIEKMLPVFIFKGPDSLREAKGQKILITPLGEIRTAND

SEQ ID NO: 7427 - protein, 1111 aa, unidentified
  REGION 1..1111: note = Description of Unknown:uncultivated organism sequence
MDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSAGDQKDGEDRKNKKNKKGKKSEKSERERIRAAISQLQQAMQTSGARTLGEYFARLDPHQERIRGRWTSRRMYKEEFEAIWTAQAPFHPEWTAADKDRLFRALFFQRPLKSQRGLVGLCPLESKVLPPAQPGQKAKVLYRHRRAPLASLEAQRLRYMQRINDLEIIAPDGTHWVLRDPAYQLMRSKLYDLAEHHEELTFPAIRKALGIPTGKKGQDWKFNLEAGGEKKLPGNTTAARIRRILGDQRWDSLGPDGQKQLVDTLLAFLSEEALQQHLEARWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWECPYTGRKKIELAALLGPEPQFDVEHIWPFDRSLDDSFANKTLCYHEENRLRKSNRTPWEAYGSDPHRWGEIIARVKGFQGEWAKEKLRRFLATELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAVEDIVDPEVRRLVQEKLQALSQHDPKLADPKKAFASPENLPYLRSRRTGQIIPIKSVRIWVTAHLEKIGSGMRQRYVIPGTNHHLEIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 7428 - protein, 1113 aa, unidentified
  REGION 1..1113: note = Description of Unknown:uncultivated organism sequence
MFQVGLDLGTNSIGWAVVAYSDKEGHVAAGSYVFPEAGEEDGGKFISHRRKRGEKRRQRKQLRRKRQRRNAVMRLLVGAQLLPKDTNERVQALTSTCPYRARSGALDRRLDPHELGCAIYHLAKRRGYLSTAALKLIGVPGVEELDAKLAAKAMEGLDTDEGERSEDDRKAIEEIKGVLDNIAQTRRRLAQGEARTLGELLYKEIERKRPVRAITGKRITQPVENALSSALGERWSGMNAAARGKAIKQLTRVADLSRKAQRTEKDELKLQELIASLASETGLAKDRIGAVAARVRPPVLGIRADRKLYQDEFDRIIAAQRHHHPKVLTDDFCESLREALFFQRPLKPTSNLVGYCSILPTRKRCHNATMLAQHSIILQRINTLRIIERADDALRERRLTPSEINLLVDALDRHDKLTWEEAADIIKLKDGEQWFDESPPADDPAARKGRKGKKGRDGLAGNKTCTAMRRAVGDAWDQLSNKRKEELIHRILTARHFRDIVPGLQRDYGFSDEQIYRIATANLPEGHNKHCAKVLRKIEPHLRKGHVYSEALELAKLREAHQSTEQLPDPDSAPEYASTTVQIANPVVQRAVKNALIVLNSIIKKHGKPEVVRVELPRDVSRTNKQRELVMKAQERKKRLNEEAAKLLQDAGLPTTGRNVLKVRLWQEAGCCSPYDPDNKLTIRQVVEECDIDHIIPRSRSLDDSYMNLTICPNQLNLVKGDKTPHEAFGADDERWSKIRNHLNALKTMPRRKKTLITCTDPETDSFVGRDFSDTSYIAREVKKAIQQLGIKVEVTRGALTAELRKLWGLEEILPLSEEEKQRIQDANAKGRFKNRDDHRHHALDAVVTALMDISTHQRLTRYYKRKETERTKGITLPEPWPGFKENVRRVIDGAPVVFQPTRGVEGALHEETARTPPTREEVERAIQQLPEHRRNRIDRAVVVGSQLVYLNDDREPRAAYDLGSNHHCIIWQRKLRDKKGRLRREMEVVTMIEAATRACCKEPVFSAEHSGRGVEWEPFLFLCKNDIVEYDDPNEGRRLMRVAKFSSWQVQGKRKTTERAELVLRPIRDAREIQDHNVRVSGQDALARILRRVILSPLGDVVGSEPPDAQHQ

SEQ ID NO: 7429 - protein, 1031 aa, unidentified
  REGION 1..1031: note = Description of Unknown:uncultivated organism sequence
MMSPGVAEPLTILGLDIGANSVGWVLIDRQEEEGPGRLKDAGVRVFEAGMNLPEESEKEASHNVERRQARQRRRLLERRRMRLYAVRRTLQDHGLLPPGDPRYDAAFKQWLSQTDPYTSRAQGLDARLEPHQIGRAIYHLAHRRGFLSNRRAPEKKDEKPKVLQKAIGHLEDEMKSAKARTLGEYLSRIAPPERRRSQYTLRKWLQEEFDKLWKSQQGHHPGLLTPELKQKIRDKIFHQRPLKSVARLVGTCELERGRKRAPRALLLAQRVRLLQEVNNAQVSIEGCPRRRLTHDERKKLVKALETSAELKFAKVKKILGFPQSVTFNLDRAGKKGFVGNKTAARLIEIFGKKGWDQLYSRDRDIVVEGLLTIQKEGDRGRDEIVKEWGKRRWSLAEEQAEALADVALEDGYPHHSVQAMDKLLPHLEAGLTHPEALERAYPDPAAATAVDRLPHAPKLRNPIVERALAETRKVVNSLIHRYGKPARIRIELTRDLKRTSREREKIWKGQRQREWERGRAEKAIANEIDRQQPSRDDIERYRLWEECNHQCPYTGRQINMADLFHESRFDVEHIIPLSRSMDNSFLNKTLCEAQCNRERKRNKTPWEAFGETSAWEDIIARVERFKADEETKKAKRRRFEMKQVDDKFTAQQLNDTAYASRMARDYLARLYGNQWKKCVEVSRGRVTAYLRRAWGLETILGAKPDEAAAETRRGKARDDHRHHAIDAAVVALTTLGAVHALSNAAKQEIPGKARFRPILPPWEGLVQQVRDAVEKMIVSHRPERRVSGQLHKETFYGFVTDPRTGQKRAVVRKRVEALTRHEIKKKEIVDPTVRAAVEARLEVLRNQDPKNAFKNPSDHPTLRTRKGCEIPIHRVRVFQAVKPKTIGSGISERRVALANNHHLEVFEKPDGSWMGEVVTMLEAMRRKKTGEPIIRRQDNEGRRLLFSLSRGEAVQINTGTGERVTAVVQTISGPNPGKVDIEFRRHSDARKAEDVRKAGDRIRVSSYADLKQREARKVLLTPLGEIRWAND

SEQ ID NO: 7430 - protein, 1058 aa, unidentified
  REGION 1..1058: note = Description of Unknown:uncultivated organism sequence
MLSLDDDDNPTGVVRLGVRCFDSGVGSEEEVAQGKEESQNVERRGARLLRRQTWRRARRIAKVFHTLQRFGLLPAEPAPTPEQRDAVIKQLDADLRAEFLPAGDRAAFHLLPYRLRALGLDQPLPPFAFGRALLHISQRRGFLTNRKAEAKKDEKDGVVKEGISFLQNELVRTGARTIGEYFAGIDPEEQRIRGRYTARQMYLDEFEKLWAVQAPHHQLDEAAKKAIHQAIFFQRPLKSQSGLIGMCELEPNQRRAPAASLEAQRFRYLQKVNDLQIITPDGFILAPSDEQRRSLIDYLEHHAEITFDKLRTLWGLKLPRKSKKKSPAASGSDGDSDLASDAAQSDDRPGYNFNLERGGEKKLKGNVTRARIEAALGCDLDELPASVREPLVADALEYENADALQRRLVQRYGLSEEQAAALAETHFEDGYFSLSLVAIRKFLPLLEQGIAYAAARKELYQQSQQFQPHNTLPPLFMVKAQLRNPAVSRGLNELRKVVNAVIRRYGKPKYIRIELARDLKQPRKVREERSKSMRKNEALRQQIIDDIRRFGIANPSETDILKVRLADECNWQCPYTGKAISMETLLGPHPQFDIEHIQPYSRSLDNSFTNKTLCDVHENRMAKRNLTPFEAYSGDEQRWHEIIARVRRFRGPAGPAKLRKFLAKELDSDFAERQLVDTRYMSRAAAEYVGLLYGGIIDSQGKRRVQVSSGGVTADLRRLWGLNRVLPRDPGDDDSRPAKKSRSDHRHHAVDAAVIALTSPAMVHQLSRCAQDATLIGSRRFVALELPFPSLIDDLKQAVDEIIVSYRVKRKVRGRLHDQTYYSPPKPYCDENGRTVECRHVRKPLASISADRIEKIVDPVVRKIVQEHLARHGGDLKKAFGNPNNLPYLTAGDGRIIPIRKVRIRENISVLPIGKPPQLRFAAPGTNHHMEIVEVTDARGRVRWEGKLVNMFEAYQRRRQHLPVVCRDHGPNAKFLFSLACGEYVEMEHVPGQRKVYRVTTISEGQLEFRLHSDARPIKELKIAGSRARVRRSPNSLLEAKARKVFVDPLGNVYPAGD

SEQ ID NO: 7431 - protein, 1069 aa, unidentified
  REGION 1..1069: note = Description of Unknown:uncultivated organism sequence
MSEHLDYVLGIDLGSNSLGWAVIGLIDGEPAQLVRAGVRVFDAGMEGDLESGREESRNLKRREARLHRRLLWRRQRRLTKLFNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRCRWTARDMYEKEFNAIWDAQAPHHADLLTPERKKQIYDAIFFQRPLWLDPGTVGNCELEPGEKRAPAYLLVSQRFRLLQTVNNLRVLPPDDVDMPLTPTDRKKLVDALEMKGDLTFKEISKLLKLEKGYKFNLESGGEKRIKGNRTNADFYAVFGERWLAMSPEERDRAVEYVHSFQKAEKLKDAARKKYDLTEEQAEQLAGISLEADYINLSRKAIEKFLPLLEEGVTYGEARKKLYPESFEAREAMPLLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPWPNFVDSVRTEIDRIIVSHRVSKKVSGALHEETIYSRPMGKDGEVRVRKPLDSLSRPEVEKIADEGVRKLVQQKLEQLGGIEPKKAFPNPENLPRFPSSGVVIKNVRITKPLPIFTLSEGRRARHVTSESNHHVEIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 7432 - protein, 1127 aa, unidentified
  REGION 1..1127: note = Description of Unknown:uncultivated organism sequence
MFSRANSVSDNDCSSVNAPAAPRDTASEAQPQPSQPSAGTNVPYVLGLDIGATSVGWAVLDLDAQGEPCCVRAMGARCFEAGVDGDIEHGKDSSRAVARRQARMARRILRRRARRLKKVFHLLQRHGLLPAGPSRTPEERHRLLADLARQLFPKYAPGGDRVAAHVVCYRLRAAALDRALEDHELGRALYHLAQRRGFLSNRRDDRRASEKGEKSQDTKVIEKEIASLKEQITASGARTLGEYLSRIDPEQQRIRKRWTSRQMYIDEFEAIWSAQSQHRPGRLTEALKRELRQAIFHQRPLKPQTQLIGRCELEPPRHPGALPPRRAPLALPVAQRFRLLQKVNDLQVIEPDGRIRPLTAEERNKLLQALSEQARMEFDDVRKLLGLSAPRKRKDKATGQQICTPGHRFNLEEGGETSIPGDTTTARLLPVLGDKWRTMPEPLRESLVRDLLDFNYPAALAEHLQRVHRFDRHEAEALSEISLEDGYAPYCRMALRKLVARMENGTPFATARKLEYPQSFAAKPPCELLPPVRRAVPDLRNPAVMRALTEVRRVVNALIRRWGKPEIIRVELARDLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHLTDTRYASRLAADYLGLLYGGTVDAAGRRRVQTSSGTATWYLRSEWDMNAVIPGLSGSPTGSASGTFIEKVRTDHRHHAIDAVAIALTSARVVKMLADAARNPEQHRRRRFAPVPPPWPNFKDEVSAAAEKIIVSHRVDRRVAGPLHAETNYSPPIVHENREYRHRRVPLSSITRSQIAQIVDDVIRQLVEQKVGSAGDPAKVFSDPRNLPVLRSRDGTRCIPIKKVRVREHVAATTVGAGPRQRHVVSGKDTLHHTVIVARQTPSGEVWEDNPVDRLEVHRRLRNGQPVIQTDWGSDARYVFHLCKNDCIEMDVESGNPSAGRQIYVVRSISKRDIAVRLHYDARTLEQIVRAKERGKFRISSADLLRRRNARKVMVSPLGEVLPCRE

SEQ ID NO: 7433 - protein, 519 aa, unidentified
  REGION 1..519: note = Description of Unknown:uncultivated organism sequence
MKSLSQENRVILGVDLGSNSIGWALFDEISGDVKAAGVRVFDAGVEGEKKEIESGREESRAKKRREARQIRRQTWRRAQRLRKLYNILQEKGLLPKGSVDEVIPKIDLSLYQRYAPHLSNAHILPYYLRAKALDEKLEPFELGRALYHLAQRRGFKGNRRINTSEDEEENRKEIIELEQKIQETGARTLGEYFSKLDPEKERIRNRRISRKMYEDEFNKIWEKQKNFHPDLTDELKDRIHDAIFHQRPLKSQKHLIGECELEPGQKRALKALLICQKFRFLQKINDTTVLEPGRTPRPFSHEERQKLISELDKKSELTFAQVRKLLKLSNDCRFTSADKGKLLGNLTAAKIIEVIGEQKWFSLPEVKRRKMVAYLLHRDTESIKNRVMREFGLDPSTAEKFAQITLEKGYIRLSIAALKKLIPLMEQGSPFETAKRQIPEYNQRLSFTCEPKEFLPPVLDTNEFSAEKSGLTIRNPMVTRALAELRKVVNALIKRYGKPDTIRIELARELKKIKKSAKK

SEQ ID NO: 7434 - protein, 1069 aa, unidentified
  REGION 1..1069: note = Description of Unknown:uncultivated organism sequence
MSPSEQSSLLELVENGDSMYGRWNCKQENWGRKMTDAKRKQTTLGLDIGTNSVGWALIETSGSSNGRIVEMGSHVFPLAVEGDVENGKYETKNSTRRLKRLMRRQNDRRKRRLKRVRSILQEAGLLPNNSDLAQAILTIDRSYLAANGGSNIPKDVLAHVVPYALRRVALDYPLEPKQLGRALYHLAQRRGFLSNRKIQQDDNEGVVKGGISELRKEMERAGARTLGEYFSRLNLEERRIRGHYTHRSMFEEEFEKIWEVQRRFHPDLLTEELRKKLHNALFFQRPLKSQKDKIGKCPFEKKARRCPWYRTEAQRFRLLQTVNHLRVVAPDGSSEPLAAEQRQSLVELLEQHDEVTCAAARKHLGLKKGFKFSIETDGAKKLKGDRTTAAMKSIFGDRWERFSESERNAILHDWVSIEKEKTLKRRAREVWGLTDEQAEEFANLSLEPDYAGLSLKAIRRILPHLEKGLSYSEAIEKEYDAFSAAEEVLDRLPPVSLAMNDLRNPIVARSLTFVRRVVNAVVSRYGKPDCIRVELARDIKQPKKEKLRRTREITERTREREKIRAEIMKRYDSRMTDPSRDDILKVQLAEECGWICPYTGKSIGWEDLFGPHPAFDIEHIIPFSISLDDSFLNKTLCHHHENRHVKGNRSPWQAYHGDPEKYEEILGRVRHFKGRAAKEKLRRFELEDLSEFEDFTERHLNDTRYASKLAMEYLSLLYGGLYDAGGKRRIQAVAGPITAKVRRWYSMTGLLGAGEKTRDDHRHHAIDAVAIALTSPGAIELLSRASAQMKDPARLAFGERAEPWGNFIPELKSRLAAIRTVHHQSRKVRGQLHEDTLYSPQENGTVYAKKPLKNMNLGETERIVDGAVRAAVLQKLAKLGEKNPAKAFAKEENLPRLKNGHVVKSARFVARVKNATLIDAPPHQRAVVAGNNHHMEIVATLDELGNEVKWEGVVVSMLEAYERRRACLKAGKPVQVVQRDHGPGKRYKFTLHCGDFIEVDMPDGKREIFVVRVLAQTKEIASAPLNDARKKSDMQKAKAWLRLIPGSLKSRNARKVVLTPFGEVRSAND

SEQ ID NO: 7435 - protein, 1062 aa, unidentified
  REGION 1..1062: note = Description of Unknown:uncultivated organism sequence
MKTKNGQVDYVLGIDLGVVSLGWAAIEIDIDGGQSLLGAGVRCWELSNASLEEVEKGKEEPPGQSRRQARQLRRQMFRRAQRLRRTYRVLQEMGLFPTGPRSSTARKAYLETLDQKAQEWLRTNVPGANNDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRTSAQIRKVIGDATWEDLGRERQKALVDTLIAFLRADTLEGYLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYAADPVRWQEILTRVRNFRGPFARQKLDRFQAEEIPPDFALRHLSDTRWISKAAADYLGHLYGGRIDPAGRQRVFTVTGGLTALFRRAWNLNAVLGGSPEKNRYDHRHHAIDALVVALTDPSMIQRFSEEAKKLLRTSDRGAVKVDPPWDTFLTDVRRHVEEIVVSFRVSRRLSGALHDQTHYSPPVEQGKTKVRKRLNALSSHEVERIVDPVVQRLVKEKLEQLGMSDPKKAFATDANLPIIRGKNHTALPVKSVRIWVSSSVIPVGDGPRRRYVVPGNNHHIEIYAVIDGQGQEVQWTGKIVSLYEAYERKKRGEPVVCRDHGPNTRFKFSLAKSEYIEWINDDGQKQLLRVVGISHNNLELRLPYDARPITLIREQRERIRATYRQLFQRRARKVMVTPLGEVLPAND

SEQ ID NO: 7436 - protein, 1062 aa, unidentified
  REGION 1..1062: note = Description of Unknown:uncultivated organism sequence
MKTKNGQVDYVLGIDLGVVSLGWAAIEIDIDGGQSLLGAGVRCWELSNASLEEVEKGKEEPPGQSRRQARQLRRQMFRRAQRLRRTYRVLQEMGLFPTGPRSSTARKAYLETLDQKAQEWLRTNVPGANNDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRASAQIRKVIGDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQLSDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKRLGTSDPKKAFATDANLPIIRGKNNTALPVKSARIWVSSSVIAVGDGPRQRYVVPGNNHHIEIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 7437 - protein, 1070 aa, unidentified
  REGION 1..1070: note = Description of Unknown:uncultivated organism sequence
MIRKNSSYVLGLDLGSNSVGWAAISFSEDTPVGVLASGVRIFEAGMEGNIEAGRGESRAAIRRAARLARRQTERRTRRRQKVYRLLQRMGLLPDGESSDVIPALDQDLLDRHRDDFCPDGLRRLDNILPYWLRTRGLDYRLEPDELGRALYHLSHRRGFQSSRRSAQKNDEELGQVKQEISQLEEEMAAANARTLGEYFARLDPHKHRIRCRWTSREMYWKEFNELWAAQQPHHPDILTEENRDRFTKALFHQRPLKSAKGLVGRCDLEPTKRRAPWACLEAQESRMLQMVNNCKVITSDGELCAFTPEERSTLLSALGQEGDLKFSKVKKLLGFKRTFHFTLEEGGETRFVGNRIAPKMREVLGDRWDEMTDVEREQVLEDLRSFQKVDALYRRAKRAYGLGEDSARQFAETELEDGYANLSRAAMRKLLPHLREGKTFMEARMAVYGRPNSLSTEVHDMLPPLTEYADLRNPVVTRALTEMRKVVNAVIRKYDKPEIIRVELAREMKQAKSHRQRTAALMRKREKERQDAAEAIAKEISSRSPRPGDILKILLADECDWTCPYTGKQISMRALLGESPQFDIEHIIPFGRCLDDSFLNKTLCYHEENRNVKGNRAPAEVYSEERLSEILQRVRAFKGDTFAVQEKLRRFQINTEQISEWSAGFIDRQMNDTRYISKFAMQYLACLYGGLWDAAGKRRVQAVSGGTTGYLRELWDLNGLLGNSNGPKTRDDHRHHAVDAVVVALTSPGSVQALTKAALQAWKRPEHRSRFISNDPPWPDFVSDVAETVQSIFISHRPRRKVRGPLHGESNYATTKDGQVHIRRQLKSLKAKEVECIADPCVRRAVLEKLHELKETNPEKAFADRNNHPVLVARNGQHIPIHKVKIQVSAKPTAFGGTRGAPRLVANKSNHHIEIVAVLDAEGSETKWEGHIVSTYEAMKRLVAADKPGARALSSRKGNANLPPVVRKDHGPSRTFLFSIAPGDTLEIRNPSAWKDTWADKPNFIVITTVSVSNSGSIEVAGHSLEDARLQKEIKKDKALYRIRSMKTMRELQPKKVNVSPLGDVTPAND

SEQ ID NO: 7438 - protein, 1063 aa, unidentified
  REGION 1..1063: note = Description of Unknown:uncultivated organism sequence
MKSLADRKPYSLGLDVGVASIGWAVIEEPEPNRPAALIRSGVHAFDEGVEGDIESGRDEARGAARRQARLPRRMFWRRQRRKYKLLRILQRARLLPDGVIGQPQAMHDYLLKLDADLRRAHLASGDRIAAHLLPYKLRARALDQALTPTELGRAFYHLAQRRGFLSNRKSMKKDEDEGVVKQGILELAAKIQAAGARTLGEYFAGLDPEAERIRKRWTARQMYIDEFNAIWQAQAPHHPSILTEAFRSELYRAIFFQRPLKSASHLIGRCELVPNARRAAVADRLFQKFRILQNVNNLEVLPSDGPARPLSAEERAKVISALTSEGDMTFARLRGKQMLKLPKGTELKVWGQDEEKKLPGHRTDEKLREVFGERWDSMSDDIRDAIVIEILSFEKPQALERRAIKAWNLDPAKAKELSELRLEQGYAAHSRKALRMLIDGDKERGIPGMQDGTRYGTARRELFPESFKSSEPVDRLPPLKKAMGEVRNPAVERTLTELRKLVNEIVRVYGKPQTIRIELARELKRARKERERLSKENAAREKLRAKARARILAEAGVQEPRRSDIEKALLWEECEGQCPYTGQSIPFASLFGPSPQFDVEHILPFSRSLDNSFLNKTLCAVAENRDRKRNNTPFEAYSRDPKRYEEILARVRRFKGDAAEKKLTRFEMQQIPEDFVSRQLNDTRHAAVKAADYLAMLYGGRTDANGRLRVQVSAGGLTAHVRNELGLNAILDDGGQKTREDHRHHAVDAIVVAMLGPRQVQILQTAAERASAQGRRLFASVEEPWTGFLDDVRKAVDSINVSWRQDRKLAGGLHEETNYSAKEHSHADKKGQLKPHRHVRKPVDTMSESQVDDIVDPIIRERVRAWIALRDAKTDDPKPPYPVSHTHDGREIPIKTVRIRKTIGVEPVGMDQTPDGPKPGPRTRYVKPGANHHTVIVATLDKYGNETRWDDYPVTRLEAHRRHAAGRPIIRKDWGENRKVKFTLTRNEYLLVRDQEGGDRLIRCISVSEGANEFRLHTDARSATEARKPGSGARIGLSGENMRKRNARKVRVTMLGDVIPCHD

SEQ ID NO: 7439 - protein, 1037 aa, unidentified
  REGION 1..1037: note = Description of Unknown:uncultivated organism sequence
MKEQSNNPITLGLDIGPNSIGWALIGNDDRGKPKEIITAGTRVFEAGLDDLQQDGKGKSRNTNRREARSRRRLLERRTRRLTVLAKNLQKCGLLPEGNLADSIERHRLFNELDNKYDDPYTLRARALKEKLSFIELGRALYHLAQRRGFLSNRKSVSDAEEEKGIKKKIGDLARTIEESGNTTLGEYFSKLDPHEERLRSRYTSRKMYLDEFEKIWEKQTEYYPDILTDEFKKKIHRIIFYQRPLKSQKGLIGECELEPGRIRAPWGLPQSQRFRYLQTINNLKVADDRKSVLREITDDEYYKIVSHLESEGDLTFAKARKILELKRTAKFNLELGGEKRLVGNRTAAKLSEIFGKDRWQKFDDSDKNAIVEDLRSIVKDETLKNRAMRVWKLSEEQAEKLSRVRLEDGYCNFSRQAIEKLTPLLENRIPLQTAIKEIYPEHFEREGEFHDLLPPFSDSGLASLRNPIVERSLTELRKVVNSIIREYGKPDIVRIELARDLKQPSKQREKATKKMRANEHARKRAAQKIMDEAKIENPSREDILKVILAEECNWTCPYTGKQISIGALLGDHPQFDIEHIIPFDRSLNNSFINKTLCDAEENRNVKRNRTPYEAYNSTSKWDDIIARVSGFNSDVKFAKLRLFKMTPEKVEEEFSKFTSRQLNDTRWASVLAKKYLGLLYGGINNDGIDAGGKRKIHAISGPGTAYLRDEWGLNAVLGDGPGKSRDDHRHHAVDAVVVALTTPGNVKLLSKSAQSSNYGKRKFTDIPPPWENFLENVRSSISPIVTSHRLSRRVRGELHKESFYGRPRVDEKGKTYVAIRKPLEKMTKKEVENIIDPAIRNIVKEKMKSLKQEDPKKAFAESENHPVIKSSNGKSIPIHKARIRMNLSETFTAGSGHRARHVISDANHHMEIVEVRNPENGEIKWEGHVVSMFEAYQRHKNGEPIVKRNYGENENFLFSLAGGDIIELDNPEDNMRELYIIRTVPKSKQLYFVPVNDARKLSDIGKKGLTAPPDSLRIRKCQKMVITPLGEIRTANN

SEQ ID NO: 7440 - protein, 1079 aa, unidentified
  REGION 1..1079: note = Description of Unknown:uncultivated organism sequence
MEDNKPGSVAVGVDIGANSIGWMVFSCTGENEGDYKQMTGLVDAGVRVFEEGVEGGLEALQKGQEKSRNTTRRDKRQIRRQLERRAMRTFGLFQLLQERALLPESKFGVSGNNMTDRWKTTVERAERDEVLRRLDQELLDKWKTKLESEGKPEEEILLLPKRFHYMLRARALDEKLDDYDLGRALYHLGQRRGFESNRKVSKKDEDKGKVKKDIEKLSQDIAEQGARTLGEYYSWLDPDAHRIRNRWTGRQMYKQEFEAIWEAQKEHHPSILTDEFKEKLEKAIFSQRPLKSQKTLIGPCEYEKGKHRAPRACLEFQRFRILKQVNNTMVQDRDFRKRDLTKEQRQALIEELERKPALKLKDAKKVIGIKSNEKFNYEGGTFTTFMGNTTADRIRKAIGDKWDELSNEDKYKLLEDVLSIKKEEALERRAVNHWGFTEEEARKLAETELEDGYCHLSRKAINKLLPIMEEGHREMEAVNVTFDPEPPVPHDFLPPVKKAVPELRNPAVERVLTELRKVMNAIVREYGKPAVIKVEMARDMKKSRNQRKEISNKNLKNRKKRDNAKEELKKIMGIEEPKRRDIEKFLLWEECKRQCPYTGQYISAEALFSQNSRFDIEHIIPFNKCFDNSFLNKTLCENEENRRKGDRTPWQAYSGNPEKYEQIIKRVEGFQGDAAQEKLKRFKMEDDELEEYISSFRTRQLNDTRYASKLAVNYLGMLYGEVIDEAGKRRVHVSNGEITHHVRNALDMNSILNDGGTKTRDDHRHHAVDAAAVTLISYGLIQRMSNAAKKADRTAGRHMFTPIEKPWEKYIEDLKKTIQNITVSHRVSRKANGPLHEETNYSPTGYDEKGKPYVHVRKPLEGMTKNDVENIVDPEVKKAVKEKIKELGKHDPKLFQDPQNLPHLNAKDGRKIPIKKARVKKSASPMTVGQGPRERHVAPGSNHHVEIFEVKDKKGKPKWEGEVVSRFEAMRRKKEKEPIVKRDHGPDKKFLFSLALGEVIEIDEEEGKRGMYVLRSVFSNIHKEKKSPRIAFVKINDARLKKEIKDSGDWKTSFLEPLRKLNCRKVSVDPLGRVRPAND

SEQ ID NO: 7441 - protein, 1079 aa, unidentified
  REGION 1..1079: note = Description of Unknown:uncultivated organism sequence
MEDNKPGSVAVGVDIGANSIGWMVFSCTGENEGDYKQMTGLVDAGVRVFEEGVEGGLEALQKGQEKSRNTTRRDKRQIRRQLERRAMRTFGLFQLLQERALLPESKFGVSGNNMTDRWKTTVERAERDEVLRRLDQELLDKWKTKLESEGKPEEEILLLPKRFHYMLRARALDEKLDDYDLGRALYHLGQRRGFESNRKVSKKDEDKGKVKKDIEKLSQDIAEQGARTLGEYYSWLDPDAHRIRNRWTGRQMYKQEFEAIWEAQKEHHPSILTDEFKEKLEKAIFSQRPLKSQKTLIGPCEYEKGKHRAPRACLEFQRFRILKQVNNTMVQDRDFRKRDLTKEQRQALIEELERKPALKLKDAKKVIGIKSNEKFNYEGGTFTTFMGNTTADRIRKAIGDKWDELSNEDKYKLLEDVLSIKKEEALERRAVNHWGFTEEEARKLAETELEDGYCHLSRKAINKLLPIMEEGHREMEAVNVTFDPEPPVPHDFLPPVKKAVPELRNPAVERVLTELRKVMNAIVREYGKPAVIKVEMARDMKKSRNQRKEISNKNLKNRKKRDNAKEELKKIMGIEEPKRRDIEKFLLWEECKRQCPYTGQYISAEALFSQNSRFDIEHIIPFNKCFDNSFLNKTLCENEENRRKGDRTPWQAYSGNPEKYEQIIKRVEGFQGDAAQEKLKRFKMEDDELEEYISSFRTRQLNDTRYASKLAVNYLGMLYGEVIDEAGKRRVHVSNGEITHHVRNALDMNSILNDGGTKTRDDHRHHAVDAAAVTLISYGLIQRMSNAAKKADRTAGRHMFTPIEKPWEKYIEDLKKTIQNITVSHRVSRKANGPLHEETNYSPTGYDEKGKPYVHVRKPLEGMTKNDVENIVDPEVKKAVKEKIKELGKHDPKLFQDPQNLPHLNAKDGRKIPIKKARVKKSASPMTVGQGPRERHVAPGSNHHVEIFEVKDKKGKPKWEGEVVSRFEAMRRKKEKEPIVKRDHGPDKKFLFSLALGEVIEIDEEEGKRGMYVIRGVSTVKPKDKPYPHLSFVRINDARLKKDIIAAKDWGTSLLDPLRKLNCRKVSVDPLGRVRPAND

SEQ ID NO: 7442 - protein, 1046 aa, unidentified
  REGION 1..1046: note = Description of Unknown:uncultivated organism sequence
MNSNTVLGLDIGTNSLGWALFKQNKNGQIANFIDIGSRIFEAGMDGDISSGNAESKAKKRRDKRSIRRSIARRRRRMEKLKKALLQNNLLPDSTCFNESIEKLDKELLEKYSVETKTQMPSKETLSHTLPFYIRARALDKRLTPHELGRALYHLAQRRGFQSNRKETANEDEGVVKQGISELRKKIKEAGVRTLGEYFAYIDPTRERIRGLWTSRDMYIDEFNKICDAQTDLINPELRKYVYNSIFFQRKLKNQKNLVGACILEPGRKRCPWYRPEAQTFRLLQSINNLRVKLPNEPERELSSEEWPQLRDALEGASGKLDKNGNLTFTKAKTLLSLPRGSKFSIEEGGEKSLKGNVINAKLYGIFGERWKNFSEAEKEAILMDIHSYEKDSSLVLRAQNAWGLSEAEAKGFAAVRLPEEYCSLSLRAILKLLPDMEEGLSYSEAVKKHYPEQFKADSEIFDLLPQVSEFSDDLRNPAVHRCLSETRKIVNSIIAIYGKPDLIRIEVARDLKKSNKEKKNLIRKNRENEKQREAAKRKIFNELKIENPSRDDILKVVLAEECSWKCPYTQKCISINSLLTEPQFDIEHIIPFSRCLDDSFVNKTLCYHEENRNVKRNMTPYEAYCGDADKYDRILLSVKGFNGRLADEKLRRFKLADISEFEDFSSRQLNDTRFAAKSAMKYLGLLYGGVYDAQGKRRVQALSGGITALIRSGLGLNDILGDGIKNRDDHRHHAVDAVAIAVTSPKTVRTLTNFLKNMEKRQSDIFKLKIKDSLTFDCWPEFKQDCSKAVGDIIVSHYVSKKVKGPLHEETIYSKPHIEKDQKGKNVEFKYVRKQLVDLEMKNVYEIVDHAVRKAVLGKLEELGEKSPKKAFSKPENIPVLKNGHPVKRVKIRKKQETETVGKKDSARNVVLGNNHHMEIVAILDNEEKEIKWEGYVVSMLEARKRLKSGKLLVRKDFGTGKVFKFSLACGDIIKLTEEDGSEVFRVIRTVPQSKQLCFVALNDARKQADIKAAGEWYSAMPNSLLKKSCKKYTVTPLGVIRRAND

SEQ ID NO: 7443 - protein, 1039 aa, unidentified
  REGION 1..1039: note = Description of Unknown:uncultivated organism sequence
MSPDIQGSLTLGLDIGTNSVGWALIKKSGRKNSQIIDMGVHVFPESVTGDVAGGRYETKNATRREKRLARRQTDRRRRRRQRILKILQNAELLPNDKNLAKAIAKIDAAFLAQHGGAEISKELMAHIVPYALRRRALDHRLEKYQLGRAFYHLAQRRGFLSNRKIPQTDEDGVVKVGISELNHEMAEASARTLGEYFAGSNPEERRIRSRYTHRDMFKSEFDAIWNAQKSDHPKVLTDDLYKALSNAIFYQRRLKSQKHLIGECLFESGQKRCPWYRPEAQRFRLLQTVNNLRVVDATGLHRAVSKDERAALLKLLETSARVTCAQARKAMGITGKGVKLNVEMGKAKTLYGDKTTASLLAVFGKRWGEFSGSKKEQVILDLVSIEKHKALKKRGEKVWGLSGEALARFTELVLENDYAGLSRKAILKLLPHLESGLSYSEAVQKEYDAFRANGKVYDLLPPVDLEYSDLRNPIVGRSLTYVRRVVNSVASRYGKPERICIELARDIKQSKQEKQRRIKDIAERTRNREKIKEQLRGYGLADPGPDDVIKIQLAEECGWVCPYTGKPIGWEDLFGPQPEFDIEHIIPFAISLDNSFLNKTLCHHHENRHVKGRRSPYQAYAGDEEKYEAILTRIKTNFRGNCKNEKLRRFKLDDLSEFEDFSNRHLNDTRYASKLAVGYLALLYGGIVDVEHKRRVQAVSGPITVIVRRWYGMTGLLGSGEKTRNDHRHHAVDAVAIALTSASTIEALSSASTKMKNVSRLAFGETVEPWNGFLHELKTRLAFVRAVHHQGRKVRGRLHEDSIFSKQPNGMVHIRKPLETLTKDDIPKIADKAVRLAVKGKMNELEEDHPQKAFANPENFPKLKRKDGSDAHVIKRVRIERKQTTVSVGSGAAERAVVGGNNHHIEIVAALDEEGTEVKWEGHVVSMLEAYRRKQDCLRRKEHPDVIKKNYGPGKLYKFSLFCGDFIELDMPEGLREVFVIRAVPQSKQIMFVQCNDARLQKEIKAAKKWFSGYPDSLRKRNARKVHLTPFGEVRNAND

SEQ ID NO: 7444 - protein, 1039 aa, unidentified
  REGION 1..1039: note = Description of Unknown:uncultivated organism sequence
MSPDIQGSLTLGLDIGTNSVGWALIKKSGRKNSQIIDMGVHVFPESVTGDVAGGRYETKNATRREKRLARRQTDRRRRRRQRILKILQNAELLPNDKNLAKAIAKIDAAFLAQHGGAEISKELMAHIVPYALRRRALDHRLEKYQLGRAFYHLAQRRGFLSNRKIPQTDEDGVVKVGISELNHEMAEASARTLGEYFAGSNPEERRIRSRYTHRDMFKSEFDAIWNAQKSDHPKVLTDDLYKALSNAIFYQRRLKSQKHLIGECLFESGQKRCPWYRPEAQRFRLLQTVNNLRVVDATGLHRAVSKDERAALLKLLETSARVTCAQARKAMGITGKGVKLNVEMGKAKTLYGDKTTASLLAVFGKRWGEFSGSKKEQVILDLVSIEKHKALKKRGEKVWGLSGEALARFTELVLENDYAGLSRKAILKLLPHLESGLSYSEAVQKEYDAFRANGKVYDLLPPVDLEYSDLRNPIVGRSLTYVRRVVNSVASRYGKPERIRIELARDIKQSKQEKQRRIKDIAERTRNREKIKEQLRGYGLADPGPDDVIKIQLAEECGWVCPYTGKPIGWEDLFGPQPEFDIEHIIPFAISLDNSFLNKTLCHHHENRHVKGRRSPYQAYAGDEEKYEAILTRIKTNFRGNCKNEKLRRFKLDDLSEFEDFSNRHLNDTRYASKLAVGYLALLYGGIVDVEHKRRVQAVSGPITVIVRRWYGMTGLLGSGEKTRNDHRHHAVDAVAIALTSASTIEALSSASTKMKNVSRLAFGETVEPWNGFLHELKTRLAFVRAVHHQGRKVRGRLHEDSIFSKQPNGMVHIRKPLETLTKDDIPKIADKAVRLAVKGKMNELEEDHPQKAFANPENFPKLKRKDGSDAHVIKRVRIERKQTTVSVGSGAAERAVVGGNNHHIEIVAALDEEGTEVKWEGHVVSMLEAYRRKQDCLRRKEHPDVIKKNYGPGKLYKFSLFCGDFIELDMPEGLREVFVIRAVPQSKQIMFVQCNDARLQKEIKAAKKWFSGYPDSLRKRNARKVHLTPFGEVRNAND

SEQ ID NO: 7445 - protein, 1198 aa, unidentified
  REGION 1..1198: note = Description of Unknown:uncultivated organism sequence
MFINRKLVLGLDLGVGSIGWCLVSKDLQDNPLEIVAIGSRVVPLSTTEVNDFKVGKSKSPSQQKRLVKSFRRNIDRYQMRRYKLVSILKYLNMMPNVELMKAPLIELWSLRSRAATVGEKLSLEEIGRVLFHINQKRGPQFRIDDESTDTVYKEAVNHRHKVIRESKQTVGQYFYCKLQNSRITNPKGKSFYTYRIKDNVLPREAYEEEFMQIMDVQMKFYPEVLTPSIISRLFDTIFFQRELKSCKKLVSVCDIEKREYPIPDKEGQYRIVGPKVAPKSSPLFQVFKIWQSISNISFTDIDGQRLYIKKDVRNKLFNHILTKGKLNARDCYNIVGVSDKEFSLDKLTLDGIKGNLTLNQISKALSLLPVTKRNELLEFDLKVEEQVDTVTGEIHNVISNDMLSEPLYKLWHTLYSLNKADERRKCLQNNFGISDEQTIDELCKLNFKKDGYCKLSSKAIRRILPYLQEGYDYAQSCLLAGFRHSDYVTTEENEGRPLQTHLPILKKNELHLPVVEKVLNQMIGIVNRLIEKNGEIDETRIELARELQRSKKEREDMDKQNRENLKRNEEIAEKLKKENGINKPTHRMLMKYRQFEETGGKCMYCGGDIDVKTFMYGIDTEWEHIIPKALLFDNSFSNSICACQKCNKTKNDRTAYDYMRSLGTQRFNDYKERVKKMYDEKSISRTKYKNLLASFEDYQERKRNGCATEEDKELWENYIDRQIRQTQYISRAALKMLKNVCRNVYASSGTVTSFLRHGWGYDNILHDLNLPVYDAAGIGLTEDVVVKQDGKDIQVHRIKGWNKRMDNRHHAIDALVVACTKQSIVQRLNEFNSSRTEFEEEVKSGKKKRFKNKKSMLEKWVEINTPFSKKEVAEKVSGIIVSYRTSNKVASSSTNRYLSNGKTIVEKGIISPRLPLHESHLYGKINGKNVYRYSLSELFLKKKDVNIEDVLKSIVDKGIVAILENRINAGIINNDSSKKPYDVDPAKAKENLATLVSKPPMHSNGTPIRRVKCYVSKPTIPVRTDSHGTVTAYAVSGNNHHIEFYRNDKGEFKESVISYWQAFLRIKNHLPLFVNIDNASILRKASEEGFDIGEIHDSSWDPFLCLGKTELVVIGLKKRTIENLIKRGDYSKIASHVYKVCGVSQGDYTFCIHNEIKYVPKERNKPDGRFIRIQNIKSLANLELVKVKINPIGEITIL

SEQ ID NO: 7446 - protein, 1080 aa, unidentified
  REGION 1..1080: note = Description of Unknown:uncultivated organism sequence
MSASSVSCQKYVLGLDLGSASLGWAVVALNDANEPTHLIRTGVRIFEPGVEGTTADIAEGKDQSKAVDRRTARLHRRQLRRRAARQRDLFKLLQQQGFLPVQDEGSTSASEERHNILNDLDSRICAKWSANSDTDSFAQLPLYKLRKTALDEKLEPFEIGRILYHLSQRRGFKSNRRDTPKNADEEKEQGRVKTGISELQSAMEQSGARTLGEYLASLDPHKVGENVRRRWTSRSMYECEFNQIWEAQIAYYPESLTPALQKQIGQLLFFQRPIAAQGHLIGKCELEPNERRASWATLEAQRFRILQKVNDLQIIYPGNPISQPLTSPEREFVFNLLDSEGDQTFANIRKHLQLDKKSVFNLERGDEKRLRGNRTNVVMRQAFAERWGAFSEEERKQIVEEWRTSESDEWLAKRGVDHWGLGPEIAATWSTKHPENGYCALSRKAIARLMPLMSEGVSFKTAETQLYGDRFSGATALDQLPVVKQYLTTLRNPAVERALTEMRKVVNAIVREYGKPYEIRIELARELKKPRQERVSATKANRKRQKEREDIMQRILQECGIPKERQSRKDIEKALLHVECGGMCPYTGRSIRFSDLFHDSQFDVEHIIPRSRYPDDSFQNKTLCYLPDNRERKRNKTPFEAYGSNEQEWAEILERVRKFGNAGKLKRFMLETLKDIEDFSARQMNDTRYASVLAGRLLGTLYGGRDVQGDVGMRQAVFVSSGAVTATLRRSWGLEAILHDLVPDTSGQGKGKPRTDHRHHAIDAIVIALTRQGMIQQMARAASTEPWQDGERTWRKIESPWRDFVDSIRPHIAELVVSHRPEHKMSGELHKGTNYSVPHLHKGKLTVHTRCALSALCAADIAAEDVIVDVAVRDAIRKKLDELGGSPKLFEKVENTPYLAARDGRQIPIRKVRIRETKNALQIGHGATARLVASGGIHHVAMFVTRDKKRCEVWKSNVVQITDIYQKLPRHDRRKGRPKSPSQGPVVFRGFPDDPDAQFVFSLMKDDTVALDVNGQARIFRVKKFSDNGQIWFVPANDAHDNATQMKSGITWSKKPNTLKELHPRKVVVDLLGKVHTAND

SEQ ID NO: 7447 - protein, 1022 aa, unidentified
  REGION 1..1022: note = Description of Unknown:uncultivated organism sequence
MTYRLGLDIGSNSVGWAALGTEGGVPVEVLRAGVRIFEAGVQGDLERGKEESRGADRRRARLQRRQTDRRRRRLKAVYSLLADYGLLPHGKSARERDSNLTALDAELARRFPEARALPYFLRARALDQRLEPPELGRALYHLAQRRGFESNRKARQRETDEERGEVLKGIQSLYGSMAETGARTLGEYFARFLPPAERRIRCRWTHRRMYQQEFETIWAAQREFYPELLTRERHDQLFEAVFFQRPLKSQEELIGDCELEPGEKRAPLWHPLAQRFRMLQVVNDLRLSEPSGVERALTPEERRQLLAELEIKGDLTFAKVRHLLHLPRGVSLNREEGGNDKLVGNRTEARMRSWFGVRWDEMAPEQRTEAIEDLVSKLTEEELFGKAVDVWKLDGTLARGYSQSGLEEGKYLGYSLKAVGRLLPLMEAGQAFMTARHSLYPETLRLGAAEDALRPVTECVPDLRNPAVARALTEVRKIVNAMIREYGKPDEIHIELARDLKSPRKERENRWKRMREQEARRKEAAEKLAKEDGNPRPSAADIEKMLLMMECGCQCPYTGRTISMAAIRNGLVQVEHIIPFSRSLDDSFVNKTLCFVDENARKRNHTPWEFYGRTGGEEWERILDRVGKFQSRVARAKLERFQMREEQVDALLGDFSTRALNDTRFASKLAAHYLAHLYGGLSDEGGRQRVFATSGMLTARLRRLWSLSRLAGLSESGEKVRDDHRQHTLDAIIIGLTELRWVKRMADAAEYGRSQGRSRISSIEAPWDGFAADVGKAIDSLLVSHRPERKISGALHKETLYAERRRRDGSQFIAVRKPVNALTKGELASIVDTVVRGRVKLAVARAGDDPGKLNDGNAPTMPSGVPIRSVRVEVRKPLRSVGSGERLRLITGGDNQHFEVFSVLDRRGSVKRWDCVIVSKAEAAERVRTKRPVVCREHGPNTCFAFTIAKGDTFEIERDGVPEVVVARVLEGDKRVSLFSIRDARRQEKRNALRCTVNELMKKYKLQKVAITVLGEKIACRD

SEQ ID NO: 7448 - protein, 1073 aa, unidentified
  REGION 1..1073: note = Description of Unknown:uncultivated organism sequence
MPAPLSSQDYILGIDLGVGSVGWAIVGTKDAQPSALVRAGVRVFAPAVEGNIESGREESRNVARRSARLQRRQTWRRSRRNLRVFRLLQTWGLLPVGASKTSQERHDLLDLLDLRILGSDWFQRKRIDNSIPEPMQVLPYLLRASALDEPLEPHFLGRALYHLAQRRGFLSNRKVSSRSKADDDSGLVKPAIADLRKQMLETGSRTLGEFFSRTSPSQARIRSRWTGRDMYEGEFTFIWDSQTVHHPTILTPERKKLLHKAIFFQRPLSSARHLIGTCELEPKHRRAPRSLLVSQRFRLLQRVNDLQIVLPGQPTRDLAPEERADVLNSLERKGDLTFPAIRKLLHLPKEAKFNLEAAGETRILGNRTNAFFLRLFGDRWDKMPSEERDQIVDYVRSFQRLDKLPTAAAKKWGLSEESAQILESDPLEPDYLNLSKAAMCKLLPLMEEGVPYAEARRQVYPQRFVSQAPQELLPPVFLAEASVGRIRNPSVVRSLTELRKVVNAVVRKFGKPKQIRIELARDLRNSRAQRERMAKSNRENEKLRADAAKRILKEIGNPGPSRRDLQKAQLWDECHGECPYTGKVISFASLFGPEPQFDIEHIIPFSRSLDNSFTNLTLCHAEHNRNVKQNRAPSEAYGSDPDTYQAILNRVRKFSSRSATEKLRRFLMTPEEIQNFVSDFAESQLNDTRYASRLASDYLGLLYGGRVDADHKLRIRATVGRITAILRDEWKLNAILNDGSTSQGGLTLKSRDDHRHHAIDAIVTALTDEGTIQTLSRAAENAYLAKRRRFAPIEEPWQGFFEDVRNEISRIVVSHRTSGRVRGPLHEQTLYSHPIPVAAGASGQKKPGKPGFEHRVRKPLESMTTEEAANIGDPVVRSLVAEKLAQFGGAVPKTVFSVPANLPVFQASDGRRIPIRRVRVRKPLTATVLGSGPSTRYVVPESNHHAEIFAELDQKGKEIEWDIFIVSLAEAIRRKHSRESVVSKNHGAQETFKFSVAPGDVIEMDVASGRRQYFVVRGTSYPSVSLAPIADARQKKELVKDHAYLRMVPNSLRKKNARKIHVTPLGDVEEAHD

SEQ ID NO: 7449 - protein, 685 aa, unidentified
  REGION 1..685: note = Description of Unknown:uncultivated organism sequence
MAPTEGAGVGQRFVADHPQGLERCAREKWGLTPEIAEELSQKRLPDAYGRYSLKALHELLPALESGRSVEEAIRSHPQYLKSRMPAEPLPLLPPVKDVLGEIRNPAVLRSLTEMRKTVNAIVRRYGKPEFMHVELARDLKKSKKERQTETGRNRDREKLRQEAVEDLRRHDPVRYANPRGTDIEKYLLAMEARWQCPYTGREYSFVDVFGEYPSVDVEHIIPRSRSLDDSYLNKVLAYRSANMEKGNRTPHEWLHESDLERYDRMIALVNGFDSRFEVGRKLRRFSMELSEPDSLLAEFTQRQLQETRYASKLACRYLGVLYGGEVDADGNRRVFACAGQVTAKLRKTWDLNQILNPVGKPEKSRDDHRHHAVDALTIALTSTKMVRDLANAAGEADRLFRRKIILPVPWVNFAEAARAGIEAIQVSHRPARKLSGPLHKDTLYSRPRKYAVEIDKKGKPVEKEYVHLRVPVVKLGTRAAAEDIVDVRVREAVMAKAEELGGGGNKFQNNWPVLHTRHGGSVPIKRVRVREVKSVVPIGKEGRDRFVFSGSNHHAAIVAEMDTKGDIKRYVFSTVTMLEALERKRQGVPVVQREHGPGMQFLCTLSDGDMVEGKRPGDAVPRLWKVHTVDKNGRIFLSAALGARKKDEIKKAHDHWEPTVNSMFAAGGARKVLVTHLGEVIPAND

SEQ ID NO: 7450 - protein, 1058 aa, unidentified
  REGION 1..1058: note = Description of Unknown:uncultivated organism sequence
MAERSDAEFVLGIDLGTNSVGWSIIGLVDGEPASLIRAGVRVFDAGLEGDIQSGQEQSKNLKRREARLHRRQLWRRARRLTKTFNLLRKFGLLPSGDASTPKERQDLINELDQTIRNSAWFPAKASSGAYPEPQQRLPYILRAAALDEPLEPHFLGRAFFHLAQRRGFLSNRIKSAKKNDDEGAVKKGISELRQAIQETDARTLGEYFAHVSPTERRIRGRWTARSMYEDEFEKIWAAQGPHQPTLLTDERKKELRQALFFQRPLWLDPRVIGRCELEPEEHRAPAYSLLAQRFRLLQTVNNLRVLPPGQPERDPSADERKNLIDDLEAKGDQTFARIRKLPGFKKCEFNLERGGEKRLMGNRTSADFQAVFGDRWSKMSAEERDSAVEYVHAFQRPDKLADAASKKWGLGDEAAERLAGVSLEPDYMSLSRKAIKRLLPLLEEGVPYATARRQLYPERFEAGAPLPSLPPVEQALTEIRNPAVKRSLTELRKVVNGVIGACGKPVQVRLELARDLKKSKKQRQALTEAMRKNERERAAAAKRIISEAGVTAPKPDDIRKFLLAEECRWQCPYTGRSISMGALFGPESQFDIEHVIPFDRSLDNSFTNLTLCYHEENRNVKRGRTPFQAYHGAERYDQILDRVARFTGERRMVAAKLTRFKMNDEELEVFLEDFRNRQLNDTAYASSLAARYLGLLYGGLNDAAGNRCVQATAGQTTAYFRSLWKLNSILNDGPSTDGGRVAKSRADHRHHAVDAVVIGLTDAGMVKRLSDAAERAPREGRKRFAALEGPWPNFVDTIRAEIGRITASHRVSKKVSGALHEETIYSGPQSEGASHVRKALATLTKSEAEDIVDPQVRKMVQKRLAQLGVEDPKKAFADETKLPFFESRDGRHIPIKRVRVKKQVPTFVLGSGRIERHVTSESNHHVEIYAQLDGQGNVGAWDGEVVSMYEAYQRQKTRKPVVRRDHGPPVKFIFSLAPGELIECDGKSGGRSLFVVRKASRLSSGQLQIGFAPINDARKAKEMQTSRAWLWATPESLSHRHPCKVLASPLGEVSETHD

SEQ ID NO: 7451 - protein, 1238 aa, unidentified
  REGION 1..1238: note = Description of Unknown:uncultivated organism sequence
MSPALDSSQKYILGLDLGSASIGWAAIRLNDQLEPTEVFDAGVRIFDPGVEVTAKISTEEAIMRGIDRSKAVGRRLARQARRQSGRKRARQNKLFKLLQANDWLPTYEEFRDEPLFAQKHLTFNRLDKELADALSGSRRRRGADAVMLDIDQALPYVLRKEALERELKPCELGKITYHLSQRRGYRPSAVDENDREESAEEEETASSSKKGKKKRETEDDGDEQSTGKVEKGISDLNTKMQAAYQTGTIKAPLIGPYFGTFIAHNPHDERIRHRWTAREMFEDEFDLVWAKQDEFYRTSHPGLTPEELEKREKLRQEIRKLLFFQRPLASTAHLIGFCDLEPEERRAPWASLEAQQFRLVQKVNNLRYFDRTDMLEKQLSEEKSAKLVMKLQEEGDQTFPAIRKLLDMPDAEFNLQKKRKPDDDPKKKINEGKIEGNRVNAVMLRVFGAERWDSFTWDEKVAIVESWRTTEGLKERERVAADQWSLDKFHAHIWAENRPPADYCKLSRKAILNLLDPAKGGMWNGVPFMTARLKVYPNPLAGKKPLDYVPEVTGPNGSIRSLTNPAVIRALTEVRKVVNAVIRKHDKPYEIRIELARELRKNRKQRKDTEEANEKNHERRLEAARRILQECKSYDPQGLDAEGLVRAKRDDVTKMLLLMECHCTCPYTGQSIGYSQLFGGEVEIEHIIPQSMMVDNSFDNLTLTFRGTNHEKLDRTPWQHFGGNQDDWENILKRVEKFGNKRKLALFQLLTPEQARKFGARRLNDTRYTSKLAGRLLMTLYGGRDVLPDAGVEVDEQDEFKDNTGRRAIFVSSGMVTALLRDAWMLNLHELIGDSATKTAETAHEKREKNKESKKKDRSDHRHHALDAVVIGLTTESLIRKINTLSASYYVQHQNDRYISLGYRELLKLVRREARPECLNGERLERLRDTFKGIVTSHRVNHRLRGELHKAGYFGKERGRTPKNDTPIRHKRISIRDLSKMEKPEDIESTIAHIVEGKNKDGSPNTTIKQIVREFGETIRGKNKKGEEVRGYRMWKEAEHRYPTLPGKRLGKPVPIKKFTTWFTKHTTSLGMEKRGKGYPERNVETGEIAYVSFFNVQNRRGTKWKWDVVKLFDAAQSIQSVPKRERARTNIFALPSDEFKKSLRDDDEVTYRFSLMKGDLVEMENGEIVIVRRFESDGRIWISAVNAAGTDKMLNETNSLHRIGLSDFLKKRPKDSDSPQPIRIDPIGNKSRIELGA

SEQ ID NO: 7452 - protein, 948 aa, unidentified
  REGION 1..948: note = Description of Unknown:uncultivated organism sequence
MSEKMQAAKTPTYGAYFANFANNNPHIERIRHRWTSREMYRKEFDLIWQKQSEFYRESHPDLLTDELKEKIANCLFFQRPLASTEHLIGKCDLEPAEPRAPWASLEAQRFRLLQKVNDLAWFLPRTMQEEPLTPEQRVLLANELQNRGDLTFEKVCELLNLPPKTEFNLERGKKKKIEGNRIVPIMQRVFRDRWNDFSTAEQENAVELWRTPEGMEERIKKAIEQLNLDQFFAQIWAEKRPPREYCRHSRKALARLLELMETGVPYATARKALYGNPFAGKEPLPLIPQIKDAVPSITNPAVMRALNELRKVVNAIIRKYGKPYQIRIELARELRKNRKQRHDTTEANEKNHERRVQAAIRILKECQKYGYDAQGRDAEGLVRERRDDVTKMLLHMECGGICPYKGGDPISYGQLFGGEVEVEHIIPQSLMVDNSFGNLTLTFRKTNLEKLGRTPWEAFGGDGKDDQWAQIIDRVKKFNNREKLGRFQQRTPAEALAFADRRLNDTRYTSKLAGRLLMSLYGGRDVAPAETQDEMEEFKDRTGRRAIFVSSGMVTALLRDAWCLNLSDVVGEEAYKCLEAEVKDGDARQKRRNEPKKKDRCDHRHHALDAVVIALTSEGMIRRINTQAANYYSRQKLAAQPQPLTYRELMKLVRREDWPECLNEDLRTIFQKMVASRKPEHKLSGALHDATFYGKERPSKDGSMKRHQRIAISNALTDVQIENICDEGIKRAVKELGDAIGGYKKWSVEKHDWPKIPNLSTGEFVPIRKVRINITKNSRPLDTGKRWKAFGQGRPERNVEEGEIAYASFFNVQDRRGTKWVSEIVKLFEATQRVRALPKAERGKQRISERHSKFPDAVFRFSLMKGDLVELLHEGKVGVFVIRSFEADNRIKVAPINAASRDDDLKKAGHLLRLGFTEFLSMGAGEDKVPRPVTIDLLGQAHYIKLRA

SEQ ID NO: 7453 - protein, 1058 aa, unidentified
  REGION 1..1058: note = Description of Unknown:uncultivated organism sequence
MAERSDAEFVLGIDLGTNSVGWSIIGLVDGEPASLIRAGVRVFDAGMEGDIQSGQEQSKNLKRREARLHRRQLWRRARRLTKTFNLLRKFGLLPSGDASTPKERQDLINELDQTIRNSAWFPAKASSGAYPEPQQRLPYILRAAALDEPLEPHFLGRAFFHLAQRRGFLSNRIKSAKKNDDEGAVKKGISELRQAIQETDARTLGEYFAHVSPTERRIRGRWTARSMYEDEFEKIWAAQGPHQPTLLTDERKKELRQALFFQRPLWLDPRVIGRCELEPEEHRAPAYSLLAQRFRLLQTVNNLRVLPPGQPERDPSADERKNLIDDLEAKGDQTFARIRKLPGFKKCEFNLERGGEKRLMGNRTSADFQAVFGDRWSKMSAEERDSAVEYVHAFQRPDKLADAASKKWGLGDEAAERLAGVSLEPDYMSLSRKAIKRLLPLLEEGVPYATARRQLYPERFEAGAPLPSLPPVEQALTEIRNPAVKRSLTELRKVVNGVIGACGKPVQVRLELARDLKKSKKQRQALTEAMRKNERERAAAAKRIISEAGVTAPKPDDIRKFLLAEECRWQCPYTGRSISMGALFGPESQFDIEHVIPFDRSLDNSFTNLTLCYHEENRNVKRGRTPFQAYHGAERYDQILDRVARFTGERRMVAAKLTRFKMNDEELEVFLEDFRNRQLNDTAYASSLAARYLGLLYGGLNDAAGNRCVQATAGQTTAYFRSLWKLNSILNDGPSTDGGRVAKSRADHRHHAVDAVVIGLTDAGMVKRLSDAAERAPREGRKRFAALEGPWPNFVDTIRAEIGRITASHRVSKKVSGALHEETIYSGPQSEGASHVRKALATLTKSEAEDIVDPQVRKMVQKRLAQLGVEDPKKAFADETKLPFFESRDGRHIPIKRVRVKKQVPTFVLGSGRIERHVTSESNHHVEIYAQLDGQGNVGAWDGEVVSMYEAYQRQKTRKPVVRRDHGPPVKFIFSLAPGELIECDGKSGGRSLFVVRKASRLSSGQLQIGFAPINDARKAKEMQTSRAWLWATPESLSHRHPCKVLASPLGEVSETHD

SEQ ID NO: 7454 - protein, 1034 aa, unidentified
  REGION 1..1034: note = Description of Unknown:uncultivated organism sequence
MESESKGDFILGIDLGSNSLGTALVSPSTSAIVHLGVRIFPAGVEGDLDKGKEESRSAKRRGARLARRQTRRRARRMYKVFRYLQTWGMLAEGPQQEVIFALQQKLERRYPETQILPYFLRAEALKRPLDVDEIARVLYHLAQRRGFLSNRAAGAKEDPKERSVVKSDIKGLKAEIDSKGFRTLGEYLASLNPHESRIRGRYTHRSMYEEEFKAIWDAQAQNHPDLLNSFRREKLQRALFHQRPLKDQSDLIGDCELAPGEKRAPLRSLLSQQVRVLGFVNNLRLRRDDGNQRTLTEPEREALLDLCSKSPKLTFGKVRTELKLGKLKFTIEEGGEKNVPCDLTSSRLRDAIGVAWDGLTPEQREDLVEDVGDPGRFVTEEEMEKCARGKWGLDAETAQRLAEVHLPDGYGRFSLAALRKLVPWLQQGLTVEEAKDNEFPDHRKAADPLPLLPPVSEVLGEVRNPAVLRALSELRKTVNAIIRRFGKPAFVRVELARDLKRGKQERLRDSNRNREREKIREEAVAELRKHDANRFANPKRSDVEKYMLAKEANQRCPYTGQVYGFTDVFGEHPSVDVEHIIPYSRCLDNSFVNKTLAFRPANAEKGNRTPHEWLHEGDPERYDRMVDIVKHFDSRFQTAPKLARFTMALTDPDSLLDEFSQRQLQETRYASKLAAKYLGALYGGVNDADGTKRVSTSAGQITAILRKAWDINRILSLSPFKSREDHRHHAIDAVSVALTSQQTVQQLSRAAEDAYRVRKHHLTLQSPWENFNADLRSAVEEIQVSHRPTRRLSGPLHEETIYGAPRKTAAGKTAVHYRVPVVTLSTEKDFSQIVDPTVRGAVVAKAQELGGGGPKFEKNWPQLRTRKGALIPIRRVRISKVTGTQVIGKPGRERSVIPGSNHHAVIYAELNLKGETARYRSCTVTMLEAYERQRQGVAVVQRDHGPGTVFRCTLSEGDLLEAKRPGTEPAAIWYVRSVKSNEKIVMSPSRDARRKDEIIASRDLWEIAANVAFKQCGARKVLVNHLGEVIPAND

SEQ ID NO: 7455 - protein, 1067 aa, unidentified
  REGION 1..1067: note = Description of Unknown:uncultivated organism sequence
MVAKHKDYVLGLQINASSIGWAAVQLSDKDDKNPVALMHPGVHLFDPGVEGSLLEIKRGKDISRAVAYRQVKQSQRIRERRLERETELFALLQMQGLLPASTNGSPKQRLDTLNNLERELEKALADRHPHNKLPYILRADALDRRLKLFELGRIFYHLVQRRGYQSNRRKPEKEGQEGAVKQGISELAQEMQKLKARTLGEYFSKIDPQKVKIRRRWTSRQMYLDEFEQIWTKQHKYYPDLLTPQLKSQIHRLLFFQRPLASAKHLVGFCEFEPKQRRAPMCSMEAQRFRMRQRINDLRICPIGQAEGSPLTKEEKEALYRLLEVNPQLTYTAVKKHFGFPKSSEFNFQRAGEKQILGNRTYAHHYKVFGDAWLKMTPEQQAETINIWNAAETEKQLVTAGMRHYLLTEEQGKLWASELPESGYCSLSKKAIARLMPHLNEGIGYTTAVEREYGEGVHFKPIHEEIPPVREVFRALANPAVERSLTQTRKIVNALVRRYGKPYRIHIELGNELRRSRKERQNIHIGNKQREASRDKLRERVSEATGIAKQNVSGSDIEKVQLWDECDGFCPYTGHKIPFDALFRGDDWMMTNILPFNRHPDNSFSNKTLIYAPELASVKRNFTPYEAYGKNEDLFDDILRRVDLFKGDLAIEKLHRFEVRSREDLEIYTQRAMNDNRFATKWAMELVGTLYGGRDVLLPQGVTRRAVCGRPSALTALVRRKWALSDLYRELPDDWRAQTLDPIAIACLDDEIFHRMTRYSKDSNAIESPWPDFIDSIRSQVDSIVPSIRVEKKLNGALHQETHYSKPVIDEQGRSWVTVRKPVTAMSKRDIEAIVSKPVREAVLRHFLALEEDLSTCAAANNWPTIQVGKRPAVPIRRARIRKALTVTKVGKEGFERYVANDRNHHMEVFEIDDANGPRYVSRTVSLLEAKTRCNRKQPVIDERLTSLNGVSGRLPKGAKYKHLFVCALMIGDLILLHRDCEHENDVCIPGIYRIRGIAANGQVTVMPLNETRSAVELDKAHEGWSPKVDALRKMGMAPVKVDLLGELHPNGGKIDLFQPRKVATHQ

SEQ ID NO: 7456 - protein, 1102 aa, unidentified
  REGION 1..1102: note = Description of Unknown:uncultivated organism sequence
MNSFRSSDSSAKRYVLGINLGCASCGWAAIGLNAQHQPTKLLRAGVRIFNPGVTGDIDRGKDESNAVARRAARLIRRQFRHRTARQAALFRLLQRNGLLPPYEGEEADASGQRHAILNRLDREIAVTWAERFPGETATDLPLYFLRKRALDEPLQPFELGRIFYHLSQRRGYQSNRKEKAFHLERAETGAKDEDLGQIEGEIEELKAAMEKAGARTLGEYFASLDPHRQKVRRRWTGRKMYEAEFALIWTKQAGYHPELLTKDLHDRIKYLLFYQRPLRSQAHLIGKCDLEPGERRAAWAMVEAQEFRLLQSVNNLEIVYPGQNVQFPLTTEQRWTVIHLLEKTAEATYETIRKALELPRGTQFNLQRNGEKRLKGNMTNALMATVFGDRWSVMPEEDKKLVVEEWRTIEREDSLMRRAQEHWKLDAAGAEWLAKHPAPAGYCAYSRKAICKLLPLLYEGIRGEEAKNVVYGSRLSGGAVYERIPPVREALKNLRNPAVERALTELRKVVNALVQEMGAKPYEVRIELMRSLKNSRRARFYSVQHNNELQNGREAAKARLLKECGIAQPSRADVEKALLWEECQGECPYTGRRFAFSSLFGENPSMRVSHIIPFSRIADDSFQNKVLCAAGEIQFKTNRTPFEAYGSDAAHYEEILTRVRNWKGTRYSGARSQRDKKKLVANAKIANPGKFRRFELHTAEEVEGFSNRQLTDARYASRSACELLETLYGGRDLKTDEERRQAVFASSGVLTTILRRRWGLDAILREPGASPNRLNTDESQSDYRHHAIDAMVVALSRPSFINALKKSAQAESSQPAAARSAVALQSPWKDFVDSIRPQVEEMLVSHRIDHRLSGALHEETNYGRPCENDGKMTVHIRKPVPGLSAAEIENIIDLKVREAVREKAALLDGSLKKWMPQKENEDWPMLKSKNGQEIPIKRVRIRKSLQVKTIGKKSRERHVSLGSNHHVAVFAITGDKGEEKRWSSQIVSLFEAMERKRKGEAVVQTSMQEDPHAVFKFALMKGDMLLLHKDCDHGKSLCQPSYWKVRSIWEQGTLTLVQIHDARQIKEIYAAKDWLLSSANTLRKLEAMKIEIDSLGRIHRAG

SEQ ID NO: 7457 - protein, 1132 aa, unidentified
  REGION 1..1132: note = Description of Unknown:uncultivated organism sequence
MPGMDFRKYTLGLDLGSASLGWALVELDDKDNPVRLMDAGVRIFDPGVVGGEAEIQKGRDKSKASERRSARQTRKQTHRRSLRQKKLFRLLQEHGLLPSAENRAQQKFSIQRHEILNALDQQLTSAWRGKATLPGSSMDMADQSLVYLLRQNAVDRKLEPFELGRILYHFAQRRGYRSNRLDADDAGESGNADTGEATESSEGATKKAKRAKEPTEKTLGEVAKGISTLRSEMDAKGTRYLGSYFAMVNPHEKRIRHRWTERAMFEEEFTAIWDKQREFHSELLTDQLEKEVRYWLFFQRPLASSNHLVGFCELEKGERRAPWATLEAQRFRLLQKVNDLRVIERGMQNERRLKKEEREHILDHLETKGDLTFKALKELLAPSIIDGANMERGIKDKIEGNRVNIHMLRVFGDRWNALSREDRQKAVEQWRTIESPETLKRVGREQWQLDENAAERWGDARLARPPKDYCNLSRLAISKVLPMMETGCPFKTVEREIYDSRFSGAEPMKLVPRVTDYLPSITNPAVMRALTELRKVANAIIREYGKPYQIRIELARELRRNRRDREKQFLDNKARQEKREKGARWILAQQSKPDPSAQDIRDVPGHMVDKWLLAEECGWKCPYTSDPARAQINYSKLFVYPEFEVEHIIPLSRCTDNSLANKTLCHRDENQRKGGRTPWEAYHEDEDRWAQILKRVSQFANGPKLREHPKLRRFKLRSLEEIEGFTRRQLTDTRYTSKLASRLLMALYGGRDTTVSADDDTAEFFDKTGRRIFASTGGVTHLLRDAWVLHPDVVLNMSSMNDGEKRKGKDRSDHRHHAVDALVIALTNEQQVKAVSLHAASKQEKKWPLDYRDLVRGLKTPWNNRDQFLGDVFHRMLVSHKPEHKLGGKLHIDTIYPEPLRDPNDGKHYVSLRRSIVGITDKQIKAIQGDNIRIAVEQKLQEHGGNSKKFDPDNLATLPVLKSRDGRLIPIKKVRVRESKSPESLMSFPGSRQVESESIHHFEFFARRDRKNREEWTHIPVSIIEAHVRYGRKNPVIARAHSEDQNAEFVFSLMKGDTVEMDYNGSRDVFKVKKFYSSGQIWFTQINNAQKDEEQKKDKTAWSVNPNPLRLLNPQKVTIDPLGRKYGVNRAT

SEQ ID NO: 7458 - protein, 1067 aa, unidentified
  REGION 1..1067: note = Description of Unknown:uncultivated organism sequence
MVAKHKDYVLGLQINASSIGWAAVQLSDKDDKNPVALMHPGVHLFDPGVEGSLLEIKRGKDISRAVAYRQVKQSQRIRERRLERETELFALLQMQGLLPASTNGSPKQRLDTLNNLERELEKALADRHPHNKLPYILRADALDRRLKLFELGRIFYHLVQRRGYQSNRRKPEKEGQEGAVKQGISELAQEMQKLKARTLGEYFSKIDPQKVKIRRRWTSRQMYLDEFEQIWTKQHKYYPDLLTPQLKSQIHRLLFFQRPLASAKHLVGFCEFEPKQRRAPMCSMEAQRFRMRQRINDLRICPIGQAEGSPLTKEEKEALYRLLEVNPQLTYTAVKKHFGFPKSSEFNFQRAGEKQILGNRTYAHHYKVFGDAWLKMTPEQQAETINIWNAAETEKQLVTAGMRHYLLTEEQGKLWASELPESGYCSLSKKAIARLMPHLNEGIGYTTAVEREYGEGVHFKPIHEEIPPVREVFRALANPAVERSLTQTRKIVNALVRRYGKPYRIHIELGNELRRSRKERQNIHIGNKQREASRDKLRERVSEATGIAKQNVSGSDIEKVQLWDECDGFCPYTGHKIPFDALFRGDDWMVTNILPFNRHPDNSFSNKTLIYAPELASVKRNFTPYEAYGKNEDLFDDILRRVDLFKGDLAIEKLHRFEVRSREDLEIYTQRAMNDNRFATKWAMELVGTLYGGRDVLLPQGVTRRAVCGRPSALTALVRRKWALSDLYRELPDDWRAQTLDPIAIACLDDEIFHRMTRYSKDSNAIESPWPDFIDSIRSQVDSIVPSIRVEKKLNGALHQETHYSKPVIDEQGRSWVTVRKPVTAMSKRDIEAIVSKPVREAVLRHFLALEEDLSTCAAANNWPTIQVGKRPAVPIRRARIRKALTVTKVGKEGFERYVANDRNHHMEVFEIDDANGPRYVSRTVSLLEAKTRCNRKQPVIDERLTSLNGVSGRLPKGAKYKHLFVCALMIGDLILLHRDCEHENDVCIPGIYRIRGIAANGQVTVMPLNETRSAVELDKAHEGWSPKVDALRKMGMAPVKVDLLGELHPNGGKIDLFQPRKVATHQ

SEQ ID NO: 7459 - protein, 1065 aa, unidentified
  REGION 1..1065: note = Description of Unknown:uncultivated organism sequence
MSSATEALQKYVLGLDLGSASLGWAMVALDSANEPTALIRAGVRIFEPGVDGTSLDIEQGKDQSKAVDRRTARLHRRQLRRRVARQRELFQLLQRSDLLPVPESGCGASSEQRHKLLNELDQVIARRFKELGESASFGQMPLYLLRKRALDHPLEATELGRILFHLSQRRGFKSNRKEVKKSAKENEDLGQVKADIHALEKEMCDAGARTLGEYFAGLDPHIQKVRRRWTARKMFEEEFAAIWTAQQPHHISLLTDELREKIARLLFYQRPIAAQEHLIGKCELEPGKQRAPWATMAAQRFRILQKVNDLRLIESGNSISKPLDEEQRARLYRLLDREGTQTFAAIRKHLGIAKGIQLNLERGDEKDLRGNRTQKSMLKVFGDRWDTFSEGKQNQIIDNWRNSESDEALIREAVEHLGLDNDAATRLVAENPQSDYCSLSLTAIGKVIPLMQTGKSFKEAETEVYGSRFSGLKVHDTLPTVRQHLVSLRNPAVERALTEMRKVVNAIIREHGKPYEIRIELARELKKPRQERVQATKSNRKREVENKRVATMMVTECGLPPDPPRKDLEKAKLFLECGGICPYTGRSIPFSQLFQNSEFDVEHIIPRSRYPDDSFQNKTLCYLPENRENKRNRTPFEAYGGDEDRWAQILARVAKWSNPGKRDRFLLQDTQQLVAFSARQMNDTRYTSVLAGRLLETLYGGRDVIESGGTRQVIFASSGAVTATLRRSWGLEGILQELIPAESGQSRGKPRTDHRHHAIDAITIALTRSSVIQAMAQAASLEPWQEDSRAWRRITSPWKDFVGSIRPHIEQMVVSHRPEHKISGELHKGSNYARPYIYQGKATVHTRCSIASLKVADIEADDTIVDPAVRNAIRSKLEELGGNPKLFEKPEDAPCLQSVDGRTIPIRIVRIRETRNPVKVGQGMRERFVASGGIHHVAFFVVRGPNRKEKWDSRVVQITDAYERRRRKLPVVSRELATIPDAEFLFSVMKDDTVEVSDPKGTRVLRVKKFNDQKQMWFVPVNDAHDDGQQMKLGIAWSKKPSGLKDLCPRKVVVDLLGKVHAAND

SEQ ID NO: 7460 - protein, 1082 aa, unidentified
  REGION 1..1082: note = Description of Unknown:uncultivated organism sequence
MSSAMETPQKYVLGLDLGSASLGWAMIALNHADEPTSLIRSGVRIFEPGVDGTALDIEQGKDQSKAVERRTARLHRRQLRRRAARQRELFQELQKAGLLPTNAAGGGASSEQRHELLNEFDRSLTLKFLKPNDDSFAQKPLYLLRTIALDHALEPFELGRVLFHLSQRRGFKSNRKETKKSAKENEDLGQVKADIHSLELAIQEAGARTIGEYFAGLDPHIEKVRRRWTARKMFEHEFALIWAAQVAHHGSLLTQELHDRVHELLFFQRPISAQKHLVGTCELERGNDKHPPKRRAPWATMAAQRFRMLQKVNDLVVIDTKNQASRKLTEEERGKLYQLLDREGTQSFASIRKYLELKGTTFNLEAGGDKDLPGNRTQKSMRTVFGVFWDEFTEGKQNQIIENWRNSESDELLMQEAMEHLGLDAEAAAVLVKESPQADYCSLSLTAIAKLMPLMMSGRSFKDVETEIYGSRFSGLAVHDTLPPVREALPTLRNPAVERAMTELRKVVNAIVREYGKPYEIRIELARELKKPRQERVKATTANRKREADNKGIAAKILNECGIANPSRADLEKAKLFVECGGICPYTGRSIPFSQLFQDSEFDVEHIIPRSRFPDDSFQNKTLCYLPENREHKRNQTPFEAYSNNPDVWAQILLRVTKWSNPGKLSRFKLQSERELADFSARQMNDTRYTSVLAGRLLAMLYGGRDVETGDSNRQVIFASSGAVTATLRRSWGFERILQAIVSPEPGDTRGKPRTDHRHHAVDAITIALTRQSVIQAMASASAFEPWQPGTRSWRRVPEPWTRPDFIGNLTEQIAQMVVSHRPEHKISGELHKGSNFSRPYLYKGKSTVHTRCELSQLKAADIAADDTIVDKAILGLIRAKFDELGGNPKAFEDPKNLPCFTTANGRKIPIRKVRIRQVKEPKLAGHGDRERFVDSGGIHHVALFVARNDTRQEQWLSEVAQVTDVYQRCPRRDKRIGRPKSIANEPAVSRKLKDNPEAEFLFSLMKDDTVELDYNGAREVFRVKKFYAAGPIWFTGVNNAQMDADQKKNKTTWSKNPNGLKTLHPRKVVVDLLGKVHPAND

SEQ ID NO: 7461 - protein, 1061 aa, unidentified
  REGION 1..1061: note = Description of Unknown:uncultivated organism sequence
MNRIADTPEYTLGLDLGSASIGWALVALDSRHIPQGLLKGGVRIFEPGVEGSTLDIERGKDQSKAVARREARLHRRQLRRRAARQRDLFLLLQQKSLLPPAADTSASLSDQRHQVLNDLDRALTSDLRRTVEAASSRAVEQSLPYYLRKSALDRKLSAVELGRVFYHLIQRRGFKSNRKEGKKAKDDDLGAVKAGISELEAQMASAGARTLGEYFAGLNSHERRIRKRWTARSMYEREFQLIWQSQRGYWPDALDDEFEAKVSRLLFFQRPIAAQEHLIGFCELEPEERRAPWAFLEAQRFRVLQKVNDLRVIEHGHLEERPLIEDEKEAVFTKLENEDDQSFAGLRKLLGLKKATFNLERGGEKRLRGNRTNSFMRSVFGVFWDEMPEEEKHKAVTLWYRTESEEKLAQKARERWALDENAAKKFADTRPEDGYCSLSLKALRRLLPEMEKGISYGKIRPELYPEERKEPKGLLPLVRDAVPSLRNPAVERALTEVRKVVNAIVRQYGKPYEIRIEMARELRKSRKEREEATRQNRTREREKEIAKTKILKECGIQNPSRSDVEKARLFEECGGICPYTGRTIEFSSLFGDSQFDIEHIIPLSRCPDDSFLNKTLCYHEENRSVKGGRTPWEAYGADEERWAQILVRVMKFDNQAKVRRFELRSEEELGEFTERQMNDTRYTTRLAVDLLSTLYGGRDIPRGDGTNRRVIHATTGMVTATLRKSWGLEAILREAVPSYNGESKGKPRTDHRHHAIDAITIALTSQAMMQRMSVAAANAPSWQSGRRSFRSMEAPWPNFVDSIRPYVESMIVSHRPEHKMSGPLHKDTIYGRPYLFEGRSVVNLRRSVQGITPAQILEIPDLAVRQAVEAKLVEHSGDSSKFNPDEPSTLPRLTTNRGEHIPIRKVRVRETKNASALLELPGNRFVQSDEIHHVELFVRRESHKEIWVHSPVTLMEAYFRHRQNTPIVARKLEDDPDAEFLFSLMKGDMVEMNYKGQRGNFRVKKFYSSGQIWFADGNNAQQDKDQQRDGTRWSKRPDALRELRPRKILVDLLGKTHPAND

SEQ ID NO: 7462 - protein, 1088 aa, unidentified
  REGION 1..1088: note = Description of Unknown:uncultivated organism sequence
MSVNGDSEQPYVLGLDLGSASLGWALIGIDALDEPVSLIRAGVRIFEPGVDGSALDIQQGKDQSKAVDRREARLHRRQLRRRVARQRELFGVLQSAGLLPTSDVPGAGIGSEQRHRILNDLDAALAKHYRTGPDIEAFSQMPLYALRKKALYEPLALDELGRVFFHLSQRRGFQSNRKDVKKKTKDDEDLGQVNSAIHELEQAIQASGAQTLGEYLAGLDPREQKVRRQWTGRRMFKEEFEKIWTAQQAYHPSLLTPEFHDRVWGLLFDQRPVSTQKHLVGKCELEPDKRRAPWAALPAQQFRVLQKVNDLRIERERGSEEPLSPKQRAAAFDLLENHGTQSFAKIKQHLGLPKTAQFNLERDKAKELKGNATAQSMRKVFGDRWKDFSEGKRNQIIENWRNAEKDEDLKREAMEHWGLDEAGASALLAEKAPADYCALSLTALSKILPLMRSGKSFKEAETEIYGNRFSGAAVHPLIPVLRPHRKHFRNSTPPPQDPLMASIANGLRNPAVERAITEMRKVVNAIVREYGKPYEIRIELARDLKKPRSKRLEDTVNNRKREAENRALAERMFQECGIPQPPSRKDLEKAKLWVEQQGECPYTGHSLPFSRLFNDDNGFDVDHILPRSRHPDDSFQNKVLCWGDTNRIVKRNQTPYEAFAEQDPENWQQVLGRVARWRNPGKLRKFEIRSTDELAEFSSRQLNDTRYTSLLAARLLSTLYGGRDVVKDGTSRRVIFASTGAVTATLRQNWGFEQILRGILPAEPGETRGKPRTDHRHHAIDAIVIGLTRDNIIQAMARASALEPWQPGTRCWRQVPQPWRTPDFYGGVEQRVREMLTSHRPEHKVNGELHKGSNYGRPYMHNGTPTVHTRKLISALKVGDIEADDVIVDRAVRDIVRTKLGEVGGNPKAFEKPENMPYMTTPAGKRIPIRKVRIRETRSPLRVGEGPRERYVASGGIHHVELFVRRDEKRRETWDSRVVQITEAYERRREKTPVVARILEGDLEAQFLFSISKDDTLEIQDGDLRRIVRVKLFYDNKQIFYVPVNDAHLDADQKKLAIVKSKYPNSLRPLEPRKVVVDLLGRVHPAND

SEQ ID NO: 7463 - protein, 1070 aa, unidentified
  REGION 1..1070: note = Description of Unknown:uncultivated organism sequence
METPQALAPKYIGNYVLGLDVGSASLGWALIQLSNADQPVSLIRAGVRIFEPGVDGTSLDIEQGKDQSKAVDRRTARLHRRQLRRRAARQRDLFALLQRVGLLPAPKGAAEATSEQRHAVLNALDNELALRFTSSVDAAFAQMPLYQLRKRALYEPLDPFELGRVFVHLSQRRGFLSNRKDTKKSVKDNEDLGQVKADIHALEKLMQEAGAQTLGEYLAGLDPHKENVRRRWTARSMFKDEFEKIWASQQPHRVDILTPELHDQIAELLYFQRPISSQSHLIGKCELEPDKQRAPWATMAAQRFRILQKVNDLRLIVPGHLDGIPLTPEQRTSLFTLLDREGDQSFANLRNKHLGVAKGVQFNLEREDEKSMRGNRTQKSMLKVFGERWDTLTEGKQNQIIENWRNSESDDLLKREAIEHLGLDEAGAQRLLDEKAQPDYCALSLKAIEKLLPLMQAGKSFKEAETEVYGSRFTGENVYDFLPPVRDHLTSLRNPAVERALTEMRKVVNAIVREFGKPYEIRIELARELKKPRQERVKATKDNIKRRKEREDVARRIVAECGLQNPSRPDIEKALLHMECGGICPYTGRSVPFSDLFHNSEFDVEHIIPRSRFPDDSFQNKTLCYSLENRQNKRHRTPFEAYSPNEELWAQILQRVRSWPIPNDGKLKRFLLSDPKELEGFSARQMNDTRYTSVLTGCLLETLYGGRDVVEDGGTRQVIFASSGKVTATLRRSWGLEGILQELVPVEPGESRGKPRVDHRHHAIDAITIALTRQGIIQAMAEAASLEPWQEGARAWRKIVSPWKNFVDSIRPHVEQMVVSHRPEHKLSGELHKGTNYSRPYIHCGKQTVHTRCALATLSTVDIDAEDVIVDAAVREAVRAKLEEIGGNPKLFEKPENTPYLVSPNGRAIAIRKVRIRETKNPLTIGSGARQRFVASGGIHHVVFFVTRDQNRREKWDSTVVQITEAYERRSRKQPVIARTLSTDTEARFLFSVMKDDIVQVTENGVTRLLRVKKFGENKQIWFVPINDAHDDANQKKLGITWSKKPNTLKDLKPQKVAVDLLGRVHPAND

SEQ ID NO: 7464 - protein, 959 aa, unidentified
  REGION 1..959: note = Description of Unknown:uncultivated organism sequence
MTSKFLKPKDDSFAQKPLYLLRKIALDHALEPFELGRVLFHLSQRRGFKSNRRETKKSAKENEDLGQVKADIHSLELAIQEAGARTIGEYFAGLDPHTEKVRRRWTARKMFEHEFALIWTAQLPHHAPLLTQELHDRVHELLFFQRPISAQKHLVGTCELERGDDKHPPKRRAPWATMAAQRFRMLQKINDLVVIDSKSQTSRTLTHEERGKLYQLLDREGTQSFTSIRKYLDFKGTTFNLEAGGDKDLPGNRTQKSMRKVFGIFWDEFTEGKQNQIIENWRNSESDESLMEEAIAHLGLDTEAAAVLVKESPQADYCSLSLTAITKLLPLMMSGRSFKDAETEIYGSRFSGFAVHETLPPVREALPTLRNPAVERAMTELRKVVNAIVREYGKPYEIRIELARELKKPRQERVKATTANRKREADNKGIAAKILSECGIANPSRTDLEKAKLFVECGGICPYTGRSIPFSQLFQDSEFDVEHIIPRSRYPDDSFQNKTLCYLPENREHKRNQTPFEAYSNNPDVWAQILLRVTKWSNPGKLSRFKIQSESELADFSARQMNDTRYTSVLAARLLAMLYGGRDVESDNGNRQVIFASSGAVTATLRRAWGFERILQAIVSPEPGETRGKPRTDHRHHAVDAITIALTRQSVIQAMANASAFEPWQPGTRSWRRVPEPWTTPDFIRSLTEQIEKMVVSHRPEHKISGELHKGSNFSIPYLYKGKSTVHTRCALSELKPADIAADDAIVDKAILALIRAKLNEVGGNPKAFEDPNNLPCFTTANGRKIPIRKVRIRQVKEPKVAAKGERERFVDSGGIHHVALIVARNETRQEQWLSEVAQVTDVYQRCPRRDKRSGRPKAIANEPAVSRKLKDNPEAEFLFSLMKDDTVELDYNGAREVFRVKKFYAAGPIWFTGVNNAQMDADQKKNRTTWSKNPNGLRTLNPRKVVVDLLGRVHPAND

SEQ ID NO: 7465 - protein, 1059 aa, unidentified
  REGION 1..1059: note = Description of Unknown:uncultivated organism sequence
MEMKQPVILGIDLGAKSVGWAVMAGDVDDAGRFEPIGLLDAGARCFEAGVDGNLDQGKDEARAVARRLHRGARRQLYRRAQRLRRALRELAAGGLLPSAVASPPEARHTYLCALDERLKSLMLADGEAAGPVQDSPIYQIRRRCLDGKRGLEEIGRALFHLAQRRGFKSNRKDSGKDDDKGKVKEGIASLGKAIDLAKSRTLGEYFSTLDPHQTRIRNRWTARTMYEAEFELIWAAQAPHHPGIMTDKTKSKIRHAIFHQRPLKSSAHLIGFCDLEPSHRRAPMGCLIFQRFRIVQKINDLTWRDENGSVCGPLAVDDPRRTALIDRLDAEGDLTMAEAKKTLGLHKKAAFLLEEGAARMLPGNRTVARLKPALGGHWNKWSAGRREAFVNELISDIEQSKWERRLVEHWGLSEEDAGRVGDLGLQDGYASLSRRAMRRLLVEMEAGVPFATAKKSLYGDRAKGRPALDNLPGVLRPPTRKFLGKINNPAVVRALTELRKVVNGIIRKYGKPVRIRIELARDIRNTRKQRQDSTKKIKDRTDERDGFKREMASKLPDLFGGRDPFKSDVEKWALADECNWVCPYTGNCITPESLFGQHAHFEVEHIIPRTRRPDDSFMNKTLCHSDKNRAKSNLTPFEAYYGTPQWDEIIVRVKRFQGSAARAKLRLFEVEKIDEDFTNRDLNDTRYASRLAKDYLGLLYGGFDGIDEAGTRCVQACCGQITSTLRNEWSLNTILGTDGEKNREDHRHHAVDAVVIALAGPRAVQILATAAGNASAEGRRRYARLGEPWGGFRANVEEVIGRVVVSHRVNQTLSGALHEGTNFSPAKNHKNEKTGKSEVVRHARKKLIGITRGQIENIVDERVKDAVTGFLGERDPKTVFKEGSAFPTLDNKKKNSGHPMPIRRVRVWERNSVISFGEGGAARHVAAGENNHLEVVADTDKHRNEIWDISNVVTRYEANRRLGASEPVVRRNWGEGKKLVMALQRGDHLELEIAGVPQLMRVVSIGTNWLQLQPPAFGSPKMEKVDRNAWLFQSARRFQAANPRKVSVSPIGEIRPCNE

SEQ ID NO: 7466 - protein, 1082 aa, unidentified
  REGION 1..1082: note = Description of Unknown:uncultivated organism sequence
MSPTLEVAQKYVLGLDLGSASLGWAMIALNQTGEPTSLIRSGVRIFEPGVDGTALDIEQGKDQSKAVERRTARLHRRQLRRRAARQRELFQELQKAGLLPTNANGAGASSEQRHQLLNELDRSLTSKFLKPNDDSFAQKPLYLLRKLALDHALEPFELGRVLFHLSQRRGFKSNRRETKKGAKENEDLGQVKADIHSLELAMQEAGARTIGEYFSGLDPHTEKVRRRWTARKMFEHEFALIWTAQVPHHAPLLTQELHYRVHELLFFQRPISAQKHLVGTCELERGDDKHPPKRRAPWATMAAQRFRMLQKINDLVVIDAKNQTSRKLTEEERGKLYQLLDREGTQSFTSIRKYLDLKGTTFNLEAGGDKDLPGNRTQKTMRKVFGIFWDEFTEGKQNQVIENWRNSESDESLMEEAIVHLGLDTEAAAVLVKESPQADYCSLSLTAITKLLPLMMSGRSFKDAETEIYGSRFSGLAVHETLPPVREALPTLRNPAVERAMTELRKVVNAIVREYGKPYEIRIELARELKKPRQERVKATTANRKREADNKGIAGKILSECGIANPSRTDLEKAKLFVECGGICPYTGRSIPFSQLFQDSEFDVEHIIPRSRYPDDSFQNKTLCYLPENREHKRNQTPFEAYSNNPDVWAQILLRVTKWSNPGKLSRFKIQSESELADFSARQMNDTRYTSVLAARLLAMLYGGRDVESDNGNRQVIFASSGAVTATLRRSWGLERILQAIVSPEPGETRGKPRTDHRHHAVDAITIALTRQSVIQAMANASAFEPWQPGTRSWRRVPEPWTTSDFIRSLTEQIEKMVVSHRPEHKISGELHKGSNFSIPYLYKGKSTVHTRCALSELKPADIAADDAIVDKAVLALIRAKLNEVGGNPKAFEDPNNLPCFTTANGRKIPIRKVRIRQVKEPQVTAKGERERFVDSGGIHHVALFVARNETRQEQWLSEVAQVTDVYQRCPRRDKRSGRPKAIANEPAVSRKLKDNPEAEFLFSLMKDDTVELDYNGAREVFRVKKFYAAGPIWFTGVNNAQMDADQKKNKTTWSKNPNGLKTLNPRKVVVDLLGKVHPAND

SEQ ID NO: 7467 - protein, 1077 aa, unidentified
  REGION 1..1077: note = Description of Unknown:uncultivated organism sequence
MHATLPAAPKYSLGIDLGSASLGWAMVRLNEANEPTQLLRAGVRIFEPAVEGNIEKGQDVSNAVARRQARLARRQLRRRAGRQKQLFKLLQHHGLLPQYEGQARDSALQRHEVLNALDRDLAAKWSNSADTDGSNFVELPLYVLRKAALGTQLEPFELGRIFYHLSQRRGFQSNRRASNSDKEEEQGKVKAGISQLEAEIEAADAETLGAYFATLDPHSQKVRRRWTHRRMFQKEFEIIWERQRSFHPTLLTEELRREISWILFFQRPIREQANLIGHCELEPDQRRASWATLEAQQFRLIQKVNDLEIIYPGQILGTPLTDAERLGLYEFLDAEGDQKFEAVRKHLGLEKNIGFNLQRGGETKLRGNVVNKIMRKAFAARWEEMDEEGKRLAVDEWRTIEGEQSLRRRFVEHWGLDGPAASALAEQTPPKGHCQLSRKAIRRLFPLMMLGQRFMAARQEIPEYRLQLKEPLERIPPVRETLNNLRNPAIERALTELRKVVNAMVGEYGKPAEVRIELARDLKKSRAERAKTTDIMRKREKERITAKERLLKELGPAFDHPSRADVEKALLWEECGGICPYTGRSIEFASLFGQAPQFDIEHILPLSRVPDDSFQNKTLCYHEENRNRKGNRTPFEAYGADPETYGQIIGRVKAWKIGNPGKLRRFELRTLEEIEGFSSRQLNDTRYSSRLAMQLLATLYGGDRIPQQDGSNRQIVFASSGSVTATLRKVWGLEEILREAVPSANGQSKGKPRTDHRHHAIDATVIALTRQGTIQAMSRAAEQAPSWMRTGRAYRGLQQPWKDFVPSIRPAIHGLLVSHRPEHRLTGELHDATNYGAPRKVNGKEVVHVRKPVSSLGVKDVESIVDPAVREAVRSKASEFDGDLSKCNPKEGVEDWPLLRTGHGKAIPIKRVRIQKTLEVETVAKGSARERYVALSSNHHVAIFAELDEHGKERRWEPIVVSLYEAMNRRRRGLPIVQQAYPGAEDCVFKFSLMGGDTVLLHRDCDHAKDICIPRAWRIRTITQTGRVALVPINDARMKVEIKSSKDWWEPGIDALRKLGCEKVVIDTLGRPHVTSD

SEQ ID NO: 7468 - protein, 1055 aa, unidentified
  REGION 1..1055: note = Description of Unknown:uncultivated organism sequence
MSILSSPQDFRSGLVLGIDLGSGSLGTALVNPAAERIEFLGVRIFPAGVEGDMENGREEPRSAKRRQARHARRQTQRRQRRLYKVFHLLQRMGLLPAGRRVDVLCQLQRDLELRYPETTVLPWFLRARALDHPLEPYELGRALYHLAQRRGFLSNRVGGKEDEAERSIVKSAIKGLSAAIQDSGKRTLAEYMVSLNPRLTPLRNKPETSNHYTHRSMFQDEFARIWDAQRQYHPEALTEHRRAKLFHALFHQRPLKDQSYLVGPCELEPEERRAPLRLLAAQRFRILGFVNNLRLRLEDGTERKLWPNERAVLLDLCEKSEKLSFAAARRALGLAKALRFTIEEGGEKNVPVDLTATRLRAALGPQWDDLSLAQKEDLVEDVGDGRRCPTDEDLDACARGKWGLPAELAEALTRVRLPDAYGRYSLKVLRELLPALEDGLTVEEAIRQHTKYAATRKPAEPLPLLPKVSDVLGEVRNPAVLRALTELRKTVNAIIRRYGKPDYTRIELARDLKKSKKERQNETSRSREREKLRQLAVEELRKHDSVRFANPRGPDIEKCLLAMEARWRCPYSGNQYGFTDVFGDHPAVDIEHIIPRSRSLDDSYLNKTLAYRSCNAEKGNRTPREWLFESDNERYERMIQVVKGSDPRFEVGKKLRRFAMELSDPDSLLREFTDRQLQETRYASKLACRYLGCLYGGATDNCGNQRVFASAGQITAKLRRAWDLNRILSGQPEKSRADHRHHAIDALTVAVSSRKLIGDLAAASGEADRLFRRKVILPVPWAGFGEQTRSVIESIQVSHRPLRKLSGPLHEETLYSQPRAHVVGADRMGRPVTKDFVHYRVSVTTLNSARDFQDIVDSSVRAAVEEKAAKLGGGGAKFLNDWPVLTTRRGDKVPIRRVRIRKVQSVVPIGQGPAQRFVIPGSNHHAEVVGQLDASGQIARYACHTVTLLQALERKRQQAPVVQREHGPGCRFVCTLSEGDLLEAQRPEDPEPRIWKVRSVRQSGQLELTPSLDARMKKEIEEAGLIWGPAVNPLFLKRARKVVVTHLGEVIPAND

SEQ ID NO: 7469 - protein, 1080 aa, unidentified
  REGION 1..1080: note = Description of Unknown:uncultivated organism sequence
MGETGSLAQSYVLGIDLGSASLGWAAISLDETGKPSGLLRAGVRIFDPAVTGDTEKGQDESNAVARRTARLIRRQLRRRAARQSDLFGLLQRHSLLPPYEGAEADASQQRHSILNTLDKQLAARWESSGGQTAADLPLYLLRKAALDAALEPFELGRVFYHLSQRRGYRSNRKEQASKKDTPGKAKKEDDLGVVEGDIKNLLEEMSRAHARTLGEYFASLDPHTQKVRRRWTGRKMYEDEFAAIWASQAAFHPVLLTEELHREIKHLLFYQRPIKAQAHLIGGCELEEGERRAAWATLEAQQFRVLQKVNDLEMILPGQVNGIPLTAEQRQTVLDLLEHSETASFDKIRKALKLDKNIGFNLQRGGETKLKGNLTNTHMAAVFAERWPEMPDADKMQIVEDWRTIPQDDSLIRRAIEHWKLDEPGAKWLAGKAAPSGYCMYSRKAIRKLLPLMATGMRLKAAENEIPEYRNRLTGGQAHDRIPPVRDTLKTLRNPAVERALTELRKVVNALIREHGKPAEVRIELARDLKKPRHERARATTQNRDREKERETMRKRIAAEFGEGFRPSRADVEKALLFEECGGECPYSGKRFPFSSLFGENSPWQVEHIIPFSRMPDDSFQNKTLCEVHENQYKANRTPREAYTDPQQYEAICNRVRNWKKPNLGKLKRFELRTTEEIEGFSSRQLNDTRYASKLACELVGSLYGGRDVAAADGKSRQVVFASSGMVTATLRRGWGLEGILREIAPAADADKKGKPRTDHRHHAIDAITIALSRPKLIAALSRANERDPYWPKTGRRFPRIDAPWKDFVDSIRPQIEQMLVSHRPEHRLTGAMHDETNYGRPRKEGGKDVVHIRKAVAGLPAGAIESIVDSAVREAVRAKAAEFGGSLEKWTPNEGKEDWPLLKTKAGKFVPIKRVRISKALGVETIAQGGRARNVALSSNHHVAIFALLDERGREKRWDSIALSLFDAMERKRKGQPLIQTSYPDAGNYVFKFSLMGGDTVLLHKECNHKENLCNPSVWRLRTIASNGQLCLMRVNDARLIKAVKDAGDWWSPRVDALRKLDATKVVIDSLGRIHQAGG

SEQ ID NO: 7470 - protein, 1054 aa, unidentified
  REGION 1..1054: note = Description of Unknown:uncultivated organism sequence
MKDVGTSKPYVLGLDIGVQSIGWALIGLDDGDRPFALRRTGVRCFDSGVGSETQIQLGNDESTNAKRRQARQQRRQLFRRAQRQRRVFRILQRAGLLPGSSAAAVDRHELLQRLDAELATQFGVPGDRVADHVLPYRLRARALGEALPPFALGRAIYHLAQRRGFLSNKKAQGDDKEEGEVKQAISKLHAEIERTGARTVGEYFSRLDPEDTRIRKRWTHRQMFLDEFEKIWAAQAPHHPRMDDGLKQKLQRAMFFQRPLRSQKGMVGRCELEPDCRRAPLASLQAQRFRYLQKINDLEITTPDGEIRTVTAEQRAVLSAAFEEKGELTFAGIRRVLGLKKTKGDEHDYEFNLERGGEKKLFGNRTGEKLARALGDRWRNLSASEQETLVHEMLCFQHEDALARRLEKAWKFDPATAAAVAAVRLEPGYSAYSRRALEQLLPKLADGVRLNTIRKDLYGDRLAESKVWDLLPPVREAFGSLRNPVVCRALTELRKLVNAIVRHYGKPKMVRIELARDMKRSRRQREDATKEMRKNEKQRDAAKAKILAELGISDPSRSDVLKFLLAEECNWECPYTGKPITPRQLVGQSPQFDIEHILPFSRSLDDSFANKTLCYHEENRNVKQHRTPWEAYHGDVQRWHEILMRCRRFRGSMAGEKQRRFQMEELPEDFAERHLNDTRYASRLAAEYVGLLFGGQVDREGKRCVQVSAGRVTAFLRDEWALNAILSGGREKTRDDHRHHAVDALVIALTEPRSIKLLTRAALRAQELGRRLLVPLDPPWGEHESFLADVRSSIETVNVSYRVDRRVSGALHQETLYSPPHHAIDGKGKPAEYHHIRKPLVNMSADEVEEIVDQSVRAAVKAKLEQIGGEPKNIFAEPANHPYFRTKDGRLIPIHKARIRKKVSVIPVGDDRRRRYVAPGSNHHIEIVANLDAQGHEESWGGLLVSLYEATRRVDAGEPVVQRDHGPGKKFLFSLTGGEYVLMRQESGENHQLCRVVVITDGQVEFRLHTDARPSTVTKKSPGARIRVSPGAMKRRGARKVAVDPLGNILPAND

SEQ ID NO: 7471 - protein, 1054 aa, unidentified
  REGION 1..1054: note = Description of Unknown:uncultivated organism sequence
MISESGAKPYVLGLDLGVQSIGWAILDLDAEGRPCAVRRAGVRCFDSGTGSETEIQMGKDESNNAKRRDARQHRRQLFRRAQRLKRVLRALQKAGLMPEGSLKPAARHEMILKLDRELAPLYAAAGDRVAGHVVPYLLRAKALDEPLSPHALGRALFHLAQRRGFLSNKKARKEKDDEGVVKAGISQLHTEIEQAGARTLGEFFARLDPEDRRIRGRWTGRQMFVDEFDQIWAAQTPYHPGLTDEIRNSIHHAIFFQRPLKSQKGLVGRCELEPHRRRAPMATLIAERFRYLQKINDLEITAPDGEVRPLSPEQKAVLREALELGGDLTFTRLRGKKLLDLKKPTDEAPGFEINLERGGEKKIPGNRTAEKFVNVLGDRWHAMPADRQDRLVQEVLQSEHEDELARRLEANWGFASDTAAQLSAIELEQGYCALSRRAMRRLLPGLEAGRRLNDVRKEIYGEKLLRGSQDCEWLPAVGKVAGSLRNPVVCRALSELRKVVNAVVRRYGKPEKVRIELARDMKKGRKRREEAWREMRQNEKLRDDARRRILQEVGISAPRPGDVLKMLLADECNWECPYTGRAITPRALLGDSPQFDVEHIIPFSRSLDNAFTNKTLCHHEENRNVKQNRTPWEAYSCDDRRWAEIVARVRRFRGGAAAAKLRRFQLQEIPADFAERQLNDTRYISRMAADYVGLLFGGRTDASGTQRVQVGRGGMTKYLRDEWSLNSILSDGDAKNRTDHRHHAVDAVVIALTDPATVQTLSRSAERAHDMGRRLFVPIDVPWGDGAGFLDEVRGAIEAVNVSYRVNRRVSGALHEDSNYSKPHPAASAKGKRAIAYRHIRKPLKNMSAKEIEAIVDDRVRECVKDHLQRFGGDLKKAFGDEHNHPYLKAHDGRIIPIHKARVRKNEATITVGAGEKQRYVSPGSNHHMEIVATLGANGEEVEWKGEIVSLYEATQRVRAGLPVVQREQKEGRKFMFSLAKNEYFMMEIEPGKAALYRVVKISAGDIEFQLHCDGRPTIFEGRKRVRKSPGALQGVKARKVAVDPLGNILPAHD

SEQ ID NO: 7472 - protein, 1040 aa, unidentified
  REGION 1..1040: note = Description of Unknown:uncultivated organism sequence
MVALDSANEPTALIRAGVRIFEPGVDGTSLDIEQGKDQSKAVDRRTARLHRRQLRRRVARQRELFQLLQRSDLLPVPESGCGASSEQRHKLLNELDQVIARRFKELGESASFGQMPLYLLRKRALDHPLEATELGRILFHLSQRRGFKSNRKEVKKSAKENEDLGQVKADIHALEKEMCDAGARTLGEYFAGLDPHIQKVRRRWTARKMFEEEFAAIWTAQQPHHISLLTDELREKIARLLFYQRPIAAQEHLIGKCELEPGKQRAPWATMAAQRFRILQKVNDLRLIESGNSISKPLDEEQRARLYRLLDREGTQTFAAIRKHLGIAKGIQLNLERGDEKDLRGNRTQKSMLKVFGDRWDTFSEGKQNQIIDNWRNSESDEALIREAVEHLGLDNDAATRLVAENPQSDYCSLSLTAIGKVIPLMQTGKSFKEAETEVYGSRFSGLKVHDTLPTVRQHLVSLRNPAVERALTEMRKVVNAIIREHGKPYEIRIELARELKKPRQERVQATKSNRKREVENKRVATMMVTECGLPPDPPRKDLEKAKLFLECGGICPYTGRSIPFSQLFQNSEFDVEHIIPRSRYPDDSFQNKTLCYLPENRENKRNRTPFEAYGGDEDRWAQILARVAKWSNPGKRDRFLLQDTQQLVAFSARQMNDTRYTSVLAGRLLETLYGGRDVIESGGTRQVIFASSGAVTATLRRSWGLEGILQELIPAESGQSRGKPRTDHRHHAIDAITIALTRSSVIQAMAQAASLEPWQEDSRAWRRITSPWKDFVGSIRPHIEQMVVSHRPEHKISGELHKGSNYARPYIYQGKATVHTRCSIASLKVADIEADDTIVDPAVRNAIRSKLEELGGNPKLFEKPEDAPCLQSVDGRTIPIRKVRIRETRNPVKVGQGMRERFVASGGIHHVAFFVVRGPNRKEKWDSRVVQITDAYERRRRKLPVVSRELATIPDAEFLFSVMKDDTVEVSDPKGTRVLRVKKFNDQKQMWFVPVNDAHDDGQQMKLGIAWSKKPSGLKDLCPRKVVVDLLGKVHAAND

SEQ ID NO: 7473 - protein, 1065 aa, unidentified
  REGION 1..1065: note = Description of Unknown:uncultivated organism sequence
MIEETVVCEYTLGLDLGSASIGWALIGLDSNHSPCKLFDAGVRIFEPGVEGNIEEGKDESKALARRTARLQRRQLRRRAARQRELFRLLQSVGLLPASDSVIDDFSLQRHEILNQLDRELLNGLKARQSASDYSQSEQLLPYVLRKEALERKLEAHELGRVLYHLCQRRGFKSNRREGGGKDKEEELGKVKQDISTLRREMGDKTLGAYFAGIDPHVRKVRQRWTARDMFETEFELIWERQSQEWPELLSAPLKAKVARLLYFQRPIAKQEHLIGHCELEKKERRAPWASLDAQRFRLLQKVNDLKIIPAGSFVEVCLTSEQRQLLLEYLEVHGGITFGDLKKLLGLPPRTHFNLERGGEKSMPGNRTNAHMIAVFGEQWRELAAESKNEIVEMWRWVESEEKLARYGQERWALDEYTAKLFAGKRAEDKYCNLSLAAIRKLRPLMEEGVAFMTARMTLYPERRDEPRELLPLVREAVPELRNPAVERALTEVRKVVNAILRKYGKPYSIRIEMARELRKPRKEREAAAKRMRQNEKERIAVKARILKEAGLPNPSRDDIERARLWEECGGICPYTGRTIEFSSLFGRESQFDVEHVIPLSRCVDDSFGNKTLCYHEENRHVKRNQTPWESYGGDEERWDDIIQRVKSWKGGTTAAKLRRFELKSTEELEGFAARQMNDTRYTTRLAVDLLRTLYGGLHVVEAGGSTRQAIFASSGAVTATLRKVWGLEGILREALPSANGENHGKPRTDHRHHAIDAIAIALSSSGTIQRMNAYAATASARDSGTRVFRGLQSPWPDFVDSIRPRILAMRVSHRPEHKMSGALHNDTLYGRPYVRDGKSLVHLRRSVKGIKPDQIANIVDGAVRAAVERRLAEYGGDVGKFNPEVPESLPYLESKRGKIPIKKVRVKETKKGLLELRNNRFVESGDIHHFELFVHRDENRRESWTHVPVSLMEASRRSAANRRNGHAEAVVSQELKDDPEAEFLFSLMKGDIVEMDHEGGRELFRVKKFYAAGPIWFSHVNNAQKDADQKRDKTHWSKVPNGLMQLKARKVTIDLLGEVHPVHD

SEQ ID NO: 7474 - protein, 1063 aa, unidentified
  REGION 1..1063: note = Description of Unknown:uncultivated organism sequence
MGEETGVLKYTLGLDLGSAAIGWALVGLDSNHSPCNLLDAGVRVFEQGVEGNIEEGKDESRALARRTARLQRRQLRRRAARQRELFRLLQSVGLLSASDPAIDDFSLQRHEILNQLDRELLNGLKACQSASDYLQSEQLLPYVLRKEALERKLEKYELGRVFYHLCQRRGFKSNRREGGGKEKREELSKVKQNISTLRHEMGEKTLGAYFAGLDPHLRKVRQRWTARDMFEKEFEAIWERQSREWPDLLSGALKSEIARLLYFQRPIAKQEHLIGHCELEKTERRAPRASLDAQRFRLLKNVNDLKIIPAGSSDEVCLTGDQRQLLLEYLEVHGGVTFVELKTLLALPARTHFNLERGEKSIPGNRTNTHMLAVFGERWQELASESKDEIVEMWRRGESEEKLARYGQERWALDENSAKLFAGKHAEDEYCNLSLKAIRELRPLMEEGVAFTMARMALYPEQRNEPREFLPLVKEAVPELHNLALERALTEVRKVVNAILRKYGKPYSIRIVMARELRKPRKERQAAAKRKRQNERERIALKARILKEADLPTPSRDDVEKARLWEECGGICPFTGRTVELSALLGPESQFDVEHIIPLSRCVDDSFGNKTLCYHEENRHVKRNRTPWEAYRGDEERWNEIIRRLKSWKPRNVAKLGRFELKSTEEVEGFAARQMNDTRYTTRLAVDLLKTLYGGLHVVEADGSARQVIFASSGMLTATLRRVWGLAAILREALPSANGENRGKPRSDHRHHAIDAIAIALSSSSTIKRMNAYAATALARDSGTRVFRGLQSPWHDFVDSIRPHILSMRVSHRPEHKMSGALHNETLYGRPYVRDGESLVHLRRSVKGIKPDQIANIVDGAVRAAVQRRLSEHGGDVGKFNPEIPESLPYLESKRGRIPIKKVRVKEIKKGLMELRNNRFVELGEIHHLELFMRRDEKGRERWTHVPVSLMEASQRNAANRRNSHLEAVVSRTMKDKPEAKFLFSLMKGDIVEMDHAGDRELFRVKKFYAVGQIWFTHVNNAQNDADQQRDRTRWSKSPNGLMQLDAHKVTIDLLGKVHPVHD

SEQ ID NO: 7475 - protein, 1066 aa, unidentified
  REGION 1..1066: note = Description of Unknown:uncultivated organism sequence
MREETVVCEYTLGLDLGSASIGWALIGLDSNHSPCKLLDAGVRIFEPGVEGNIEEGKDESKALARRTARLQRRQLRRRAARQRELFRLLQSVGLLPAGNSAIDDFSLQRHEILNQLDRELLSGLKASQCASDYSQSEQLLPYVLRKEALERKLQAHELGRVLYHLCQRRGFKSNRREGGGKEKEEELGEVKQHISTLRQEMGDKTLGAYFAGLDPHLRKVRQRWTARDMFETEFEAIWERQSQECPELLSTGLKAKVARLLYFQRPIAKQEHLIGHCELEKTERRAPWASLDAQRFRLLQKVNDLKIIPAGSFDEVSLTGEQRHLLLEHLGIHGGITFGELKNLLSLPVRTHFNLERGGEKSMPGNRTNAHMLAVFGEQWRELAAESKNEIVEKWRQEESEDELARYGQEQWALDEHIAKLFAGKRAEDKYCNLSLMAIRKLRPLMEEGIAFMTARMALYPEQREEPRELLPLVKEAVPELRNPAVERALTEVRKVVNAILRKYGKPHSIRIEMARELRKPRKEREAAAKRMRQNEKERIAMKARILKEVGLPNPSRDDIERARLWEECGGICPYTGRTIEFSSLFGRESQFDVEHIIPLSRCVDDSFGNKTLCYHEENRHVKRNQTPWEAYCGEEERWDSILQRVKAWKVGTAAAKLRRFELKSTEELEGFAARQMNDTRYTTRLAIDLLKTLYGGLHVTEAGGSTRQAIFASSGAVTATLRKVWGLEGILREALPSANGDNRGKPRTDHRHHAIDAIAIALSSPSTIQRMNAYAAATAPVRDSGTRVFRGFQSPWSDFVDSIRPRILEMRASHRPEHKMSGALHNDTLYGRPYVRDGKSLVHLRRSVKGIKPDQIANIVDGAVRAAVERRLAEHGGDVGKFNPEIPESLPYLESKRGRIPIKKVRVKETKKGLMELRNNRFVESGDIHHFELFVQRDENRRESWTHVPVSLMEATRRNAANQRNRQVEAVVSRTMKDDPEAEFLFSLMKGDIVEMDFDGGRDLFRVKKFYANGQIWFSHVNNAQKDADQKSDNTRWSKRPNALKPLNAQKVTLDMLGKVHPVHD

SEQ ID NO: 7476 - protein, 685 aa, unidentified
  REGION 1..685: note = Description of Unknown:uncultivated organism sequence
MAPTEGAGVGQRFVADHPQGLERCAREKWGLTPEIAEELSQKRLPDAYGRYSLKALHELLPALESGRSVEEAIRSHPQYLKSRMPAEPLPLLPPVKDVLGEIRNPAVLRSLTEMRKTVNAIVRRYGKPEFMHVELARDLKKSKKERQTETGRNRDREKLRQEAVEDLRRHDPVRYANPRGTDIEKYLLAMEARWQCPYTGREYSFVDVFGEYPSVDVEHIIPRSRSLDDSYLNKVLAYRSANMEKGNRTPHEWLHESDLERYDRMIALVNGFDSRFEVGRKLRRFSMELSEPDSLLAEFTQRQLQETRYASKLACRYLGVLYGGEVDADGNRRVFACAGQVTAKLRKTWDLNQILNPVGKPEKSRDDHRHHAVDALTIALTSTKMVRDLANAAGEADRLFRRKIILPVPWVNFAEAARAGIEAIQVSHRPARKLSGPLHKDTLYSRPRKYAVEIDKKGKPVEKEYVHLRVPVVKLGTRAAAEDIVDVRVREAVMAKAEELGGGGNKFQNNWPVLHTRHGGSVPIKRVRVREVKSVVPIGKEGRDRFVFSGSNHHAAIVAEMDTKGDIKRYVFSTVTMLEALERKRQGVPVVQREHGPGMQFLCTLSDGDMVEGKRPGDAVPRLWKVHTVDKNGRIFLSAALDARKKDEIKKAHDHWEPTVNSMFAAGGARKVLVTHLGEVIPAND

SEQ ID NO: 7477 - protein, 1060 aa, unidentified
  REGION 1..1060: note = Description of Unknown:uncultivated organism sequence
MDQKQPVILGIDLGAKSIGWAVMAADVDEAGHLEPVGLLNAGARCFEAGVDGNLEQGKDEARAVARRMQRGMRRQLYRRAQRLRRSLRALAECGFLPGAVASPPEARHDYLSKLDERLKALMLADGEPAGPVQDSPIYQIRRRCLEGKRTLEEIGRAFFHLAQRRGFKSNRKDTSKDDEKGKVKSGIANLAKEINTIPEPRTLGKYLSTLDPHQTRIRNRWAARSMYEDEFNAIWTAQAHHHPQVMTGEAKTKIHHAIFHQRPLKSSADLIGFCELETRRRRAPMGCLIFQRFRIVQKINDLTWRDENGAICGPLSIDDPRRAALIDCLDRDGDLTMAAAKKMLGLHKKATFLLEEGAAKILPGNRTVVRLKPALGQHWENWTAGQREAFVNELISDIEQSEWEDRLVKHWKLSKEEAGRVADLGLQSGYASLSRRAMRRLLAEMEAGVPYATAVKKLYGDRAKGRPALEKLPGVLEPGTRKYLGKINNPAVVRALTELRKIVNAIVLKYGKPVRIRIELARDIRNTRKQRQNITQTIKDRTGEREDFKKSMATKLPGLFGGRDASRSDVEKWALAEECNWVCPYTGKCITPETLFGAHAEFDVEHIIPRSRRPDDSFANKTICHVDENRAKKGNKTPFEAYHGGTGWNDILARVKRFQGSGARGKLRLFEVETIDEGFTNRDLNDTRYASRLAKDYLGLLYGGGDGIDPSGTRCVQACCGQITATLRNEMGLNKILSDDGEKNRQDHRHHAVDAVAIALAGPRAVQILATAAARAAEEGRRRYAYLPEPWAGFRSNVQEVVERIVVSHRVNQTLSGAMHEGTNFSAAKSRANSKTGKVEEVRHVRKKLIGISPGQVENIVDPRVRKAVMDFLDGRDPKAVFKEGSKFPTLLNRNNIDRPVPIRRVRVWEKNRVISIGKGGATRHVAPGENNHLEIVASTDKRGKENWDISNIVSRYEAYLRLSAGEPIVKRNWNEGHELVLTLRRGDCLELDIVGIRQVMRVTSIGVDWIQTQPLSYGAPKMEKEERNSWLFRSGKGLQAANPRKVSISPIGEVRPCNE

SEQ ID NO: 7478 - protein, 1071 aa, unidentified
  REGION 1..1071: note = Description of Unknown:uncultivated organism sequence
MTRNVAVPEYTLGLDLGSASIGWALVALDSCHRPTGLLSAAVRIFEPGVEGSSLDIEQGKDKSKAVARREARLHRRQLRRRAARQRDFFLLLQRKGLLPAAPDCSADLSSQRHQVLNELDLFLTAELRPSLAEQDVEVIEQLLPYYLRKSALNRKLTAYELGRVFYHLIQRRGFKSNRREGKKQNEEIGKVKAGISELSKQIAESGSRTLGEYFAGLNPHERRIRGRWTARSMYEQEFSLIWQAQQPHWQEVLDADFNAQVRELLFFQRPIAAQEHLIGFCELELKERRASWASLEAQRFRILQKVNDIAVIAPGDVTERKLTASERDAVYALLDQEGDQTFPALRKKLGLKLVHFNLERGGEKKLRGNRTNALMRRVFCDSWQEMPPETQAEVVARWASTESEDDLVEWLKKEWALEESAARDLATNHPEDGYCSLSLKALRKVIPRMEGGEAYETARRSLYPDLFKPKAPLDELPIVRKALPTLRNPAVERALTEVRKVVNAIVREYGKPYEVRIEMARELRKSRKEREEATRQNRSRQKQREVEKERILRECGIQNPSRSDVEKALLFDECGGICPYTGRTIEFSSLFGDSQFDVEHIIPLSRCPDDSFLNKTLCYHEENRSRKRNSTPWEAYGTDEEQWNLILQRVRSWQPGNDAKLRRFQLRTETELEEFTQRQMNDTRYTTRLAVDLLSTLYGGRDIPCGDGTNRRVIHATTGMVTATLRKSWGLEAILREAAPAPTAERRGKPRTDHRHHAIDAITIALTSQAMVQRMSVAAANAPGWQQDRRVFRGIESPWPNFVDSIRPAIADMIISHRLEHKISGAFHDETNYGRPRLEGKKSYVHIRKPITALGEKDIASIVDPEVRRAVAEKFASLGGDLTRCETTNDWPGLPAANGRTIPIRKVRIRKVLNVSPIGNGNRQRFVMPSSNHHVEIFAKLDKRGKESGWEGIVISLMDAAERKRKGEPIVARTYGESDEYAFKFSLMGGDTVELHRNCDHASGKCSPSLYRLRTIAANGQLSLVRINDARLKDDIKKAKEWWSPMCGGLRKLDCRKVVVDLLGRVHPAND

SEQ ID NO: 7479 - protein, 1137 aa, unidentified
  REGION 1..1137: note = Description of Unknown:uncultivated organism sequence
MPEADRCKYTLGLDLGSSSLGWALIELDADDHPLRLMNAGVRIFDPGVVGGETEIERGRDKSKASERRLARQRRKQTYRKSLRQKQLFRLLQQHGLLPLAEYGQRQSFSAQRHEILNGLDKQLVAAWRGKATVSGTDMDLADQSLVYLLRRNAVESQLRPFEIGRILYHLAQRRGYFSNGLDEDDAINSGNTDASESIETEKKSRKMKGTKEKTLGEVAAGISSLRIDMEAKDTRYVGSYFALVNPHEKRIRHRWTERAMFLEEFTAIWNKQKEFYPELLTDELEAKVRYWLFFQRPLASANHLIGFCELEKGQRRAPWATLEAQRFRLLQRVNDLRVIERGMSNERPLRREERERILDYLETKGDLSFKALKDLLGSTGVLGFNLERGVKDRIEGNRVNVHMLRVFGDEWNSLSMEDKHKAVEQWRTVKPEKLEQIAIEQWHLNEFAAKRWGDTKLARPPKDYCNLSRLALSKVIPLMEGGCPFKTVEREIYGNRFSGAKPLDFVPKVMDYLPSITNPAVMRALTELRKVVNAIVCEYRKPYQIRIEFARELRKNRRDRERQFFDNKARQEKREKGARWILAQQNRSNPTAQDIRDVPPYMIEKWLLAEECHWICPYTKKAINYANLFTYPEFEVEHIIPLSRCTDNSFANKTLCHRSENQAKGGKTPWEAYHEDEDRWAQILKRVSLFANGPRIGDHPKLRRFKLRSLEEIEGFTRRQLTDTRYTSKLAARLLMALYGGRDTVASVDDDTAEFFDKSGRRIFASTGGVTKLLRDAWLLHPDVVLDLPSTNNGEKRKGKDRSDHRHHAVDALVIALTTEQQVRDVSLHAQSKMGNKWPLDYRDLVRGLNAPWIDRDRFLGDVFHRMLVSHKPEHKLAGSLHKDSIYGKTRDFTPAGRPIVHERIPIDNKLTSDDIDNIVDNNVREAVLRMKEVIGDFKKWSVEKHGYPSLKTKDQHSVPIKRVRIRRTKETAAIGVNHAETSDGTRILDNSRHVDASEKHHVTLFVSRKETGKAKKLREKWVSEYVSVLEAHRRHSAGLPVICKQYRNDPEAEFLCSLRKGDIVDLGPDDQRDYYILTSIEADGRINFVPITAAGKRAEQGSVRIREMADGLRPLNLKKVFIDLLGMPHFINEASQ

SEQ ID NO: 7480 - protein, 1127 aa, unidentified
  REGION 1..1127: note = Description of Unknown:uncultivated organism sequence
MPGMDFRKYTLGLDLGSASLGWALVELDDSDNPVRLMDAGVRIFDPGVVGGEAEIQKGRDKSKASERRSARQTRKQTYRRSLRQKKLFRLLQEHGLLPSEENSAQQKFSAQRHEILNTLDQKLTAAWRGKATLPGSSMDMADQSLVYLLRQNAVDRQLEPFELGRILYHFSQRRGYRSNRLDADNADDLGNADAVDATEPEETKKKAKAAKEPTEKTLGEVAKGISTLRSEMEAKGTRYLGSYFAMVNPHEKRIRHRWTERAMFEEEFTAIWNKQREFYSELLTDQLEKEVRYWLFFQRPLASSNHLIGFCELEKGERRAPWATLEAQRFRLLQKVNDLRVIERGMQNERRLKKEERERVLDHLETKGDLTFKALKELLAPVVIDGSNMVRGVKDKIESNRVNVHMLRVFGDRWNVLSREERQKAVEQWRTIESAETLKRVGIEQWQLDENAAARWGDTKLARPPKDYCNLSRLAISKVLPMMETGCPFKTVEREIYGNRFSGAEPMRLVPRVADYLPSITNPAVMRALTELRKVTNAIIREYGKPYQIRIELARELRRNRKDREKQFLDNKARQERREKGARWILAQQSKPTPSAQDVRDVPGHMVDKWLLAEECRWLCPYTGKSINYTSLFSYPEFEVEHIIPLSRCTDNSLTNKTLCHRDENQRKGNKTPWVAYHEDEDRWAQILKRVSQFTNGPRIGDHQKLRRFKLSSTEDIEGFTRRQLTDTRYTSKLASRLLMALYGGRDTTVSADDDTAEFFDKTGRRIFASTGGVTHLLRDAWVLHPDVVLNMPSMNDGEKRKGKDRSDHRHHAVDALVIALTTEQQVKAVSLHAASKQEKKWPLDYRDLVRGLKTPWNNRDQFLGDVFHRMLVSHKPEHKLGGKLHIDTIYPEPLRDPNDGKHYVSLRRSIVGITDKQIKAIQGDNIRMAVEQKLREHGGNSKKFDPDNLATLPVVKSRDGRLIPIKKVRVRESKSPESLMSFPGSRQVESESIHHFEFFARRDRKNREEWTHIPVSIIEAHVRYGRKNPVIAHAHPEDQNAEFVFSLMKGDTVEMDYNGSRDVFKVKKFYSSGQIWFTQINNAQKDEEQKKDKTAWSVNPNPLRLLNPQKVTIDPLGRKYGVNRAT

SEQ ID NO: 7481 - protein, 1080 aa, unidentified
  REGION 1..1080: note = Description of Unknown:uncultivated organism sequence
MSASSVSCQKYVLGLDLGSASLGWAVVALNDANEPTHLIRTGVRIFEPGVEGTTADIAEGKDQSKAVDRRTARLHRRQLRRRAARQRDLFKLLQQQGFLPVQDEGSTSASEERHNILNDLDSRICAKWSANSDTDSFAQLPLYKLRKTALDEKLEPFEIGRILYHLSQRRGFKSNRRDTPKNADEEKEQGRVKTGISELQSAMEQSGARTLGEYLASLDPHKVGENVRRRWTSRSMYECEFNQIWEAQIAYYPESLTPALQKQIGLLLFFQRPIAAQGHLIGKCELEPNERRASWATLEAQRFRILQKVNDLQIIYPGNPISQPLTSPEREFVFNLLDSEGDQTFANIRKHLQLDKKSVFNLERGDEKRLRGNRTNVVMRQAFAERWGAFSEEERKQIVEEWRTSESDEWLAKRGVDHWGLGPEIAATWSTKHPENGYCALSRKAIARLMPLMSEGVSFKTAETQLYGDRFSGATALDQLPVVKQYLTTLRNPAVERALTEMRKVVNAIVREYGKPYEIRIELARELKKPRQERVSATKANRKRQKEREDIMQRILQECGIPKERQSRKDIEKALLHVECGGMCPYTGRSIRFSDLFHDSQFDVEHIIPRSRYPDDSFQNKTLCYLPDNRERKRNKTPFEAYGSNEQEWAEILERVRKFGNAGKLKRFMLETLKDIEDFSARQMNDTRYASVLAGRLLGTLYGGRDVQGDVGMRQAVFVSSGAVTATLRRSWGLEAILHDLVPDTSGQGKGKPRTDHRHHAIDAIVIALTRQGMIQQMARAASTEPWQDGERTWRKIESPWRDFVDSIRPHIAELVVSHRPEHKMSGELHKGTNYSVPHLFMSSMRVHTRCALSALCAADIAAEDVIVDVAVRDAIRKKLDELGGSPKLFEKVENTPYLAARDGRQIPIRKVRIRETKNALQIGHGATARLVASGGIHHVAMFVTRDKKRCEVWKSNVVQITDIYQKLPRHDRRKGRPKSPSQGPVVFRGFPDDPDAQFVFSLMKDDTVALDVNGQARIFRVKKFSDNGQIWFVPANDAHDNATQMKSGITWSKKPNTLKELHPRKVVVDLLGKVHTAND

SEQ ID NO: 7482 - protein, 1064 aa, unidentified
  REGION 1..1064: note = Description of Unknown:uncultivated organism sequence
MSKETVACEYTLGLDLGSASIGWALIRLDSNHSPCNLLDAGVRIFEPGVEGNIEEGKDESKALARRTARLQRRQLRRRAARQRELFRLLQAEGLLPSSDSAIDDFSLQRHEILNRLDKELLNGLKAHQGVSDYLQAEQLLPYVLRKEALERKLEAHELGRALYHLCQRRGFKSNRREGGGKEKEEELGKVKQDISTLRQEMGEKTLGAYFAGLDPHLRRVRQRWTARDMFEKEFEAIWERQSREWPELLSVPLKAEVARLLYFQRSIAKQEHLIGHCELEKTERRAPWASLDAQRFRLLQKVNDLKIIPAGSFDEVCLTGEQRHSILEHLEVHGGITFGDLKKLFGLPPRTHFNLERGGEKSMPGNRTNAHMLAVFGEQWRELAAESKNEIVEMWRREESEEKLTRYGQERWALDEYTAKLFAGKSAEDKYCNLSLTAIRKLLPIMEEGVAFMTARTALYPEQRDEPRELLPLVKEAVPELRNPAVERALTEVRKVVNAILRKYGKPYSIRIEMARELRKPRKEREAAAKRMRQNEKERIAMKARILKEAGLPNPSRDDIERARLWEECGGICPYTGRTIEFSSLFGRESQFDVEHIIPLSRCVDDSFGNKTLCYHEENRHVKRNQTPWEAYEKVEERWNDIIQRVKSWKGGNAAKLRRFELKSTEELEGFSARQMNDTRYTTRLAIDLLKTLYGGLHIANADGSIRQAIFASSGMVTATLRKVWGLEGILREVLPSANGENHGKPRTDHRHHAIDAITIALSSSSTIQRMNAYAAMASARDSGTRVFRGLQSPWPDFVDSIRPRILAMRVSHRPEHKMSGALHNDTLYGRPYVRDGKSLVHLRRSVKGIKPDQIANIADTAVRAAVEKRLAEHGGDVGKFNPEIPESLPYMESKRGRIPIKKVRVKETKKGLLELKNNRFVELGDIHHFELFVQRDENRRESWTHVSVSLMEASQRNAANRRDGEKRSVVSHQMKDDTEAEFLFSLMKGDIVEMDYQGGRELFRVKKFYAAGRTWFAHVNNAQKDADQKRDGTCWAKPPNGLMQLNARKVTIDLLGHVHPVHD

SEQ ID NO: 7483 - protein, 1068 aa, unidentified
  REGION 1..1068: note = Description of Unknown:uncultivated organism sequence
MDQTAEVAKYTLGLDLGSASIGWALIAPDSSYNPHKLLRAGVRIFEPGVEGSMSEIERGKDESKAIVRRNARLHRRQLRRRAARQRDLFLLLQQKSLLPLAADASANLSDQRHQVLNDLDRELTSKLRQTVEAGSLRAVEQSLPYYLRKSALDRKLSTFEMGRVFYHLIQRRGFKSNRREGKKAKDDDVGKVKAGISELEALMTSAGSRTLGEYFAGLNPHERKIRGRWTARAMYEHEFELIWQTQRTYSPDVLDDDLKPRISRLLFFQRPIAAQEHLIGFCELEKDERRTPWAFLEAQRFRALQKVNDLRVIEHGKLAERSLTDDERNTVFAKLEDEGDQSFAELRKLLGLKKTNFNLELGGEKGLRGNRTNSFMRSVFGVFWDEMPEEEKHKAVTLWYRTESEEKLAQKARERWALDENATKKFVETRPEDGYCSLSLKALRRLLPEMETGISYGEIRPRLYPEARKQPKDLLPLVREAVPSLRNPAVERALTEVRKLVNAIVRQYGKPHEIRIEMARELRKSRKEREESTRQNRTRQRERDEAKVKILKESGIQNPSRSDVEKALLFEECGGICPYTGHSIEFSSLFGDSQFDIEHIIPLSRCPDDSFLNKTLCYHEENRSVKGNHTPWEAYGADEERWAQILARVGKFGNPAKLRRFELRSEEELGEFTARQMNDTRYTTRLAVDLLSTLYGGRDIPRGDGTNRRVIHATTGMVTATLRKSWGLEAILREALPSSNGESKGKPRTDHRHHAIDAIVIALTSQSAVQQMSVAAARAPSWQSGGRSFRGMEAPWPNFVDSIRPHIGSMVVSHRPEHKMSGALHDETNYGRPRLEGKKLVVHTRKLVVSLGKRDIASIVDPVVRRAVEEKFSALGGDLSRCETANDWPLCPTNNGKAVPIRRVRIRKVLNVSTVGKGTGQRFVMPANNHHIEVFAKLDAHGKEVRWDNIVVSLLDAVERKRQQVKVVQRSYRDTDDYIFKFSLMGGDIVQLHKNCDHAAGKCSPSLYRLRTIAANGQLSLISVNDARLKDEIRKVKEWWSPRCDALRKLDCQKVQIDLIGRVHPVND

SEQ ID NO: 7484 - protein, 1073 aa, unidentified
  REGION 1..1073: note = Description of Unknown:uncultivated organism sequence
MPAPLSSQDYILGIDLGVGSVGWAIVGTKDAQPSALVRAGVRVFAPAVEGNIESGREESRNVARRSARLQRRQTWRRSRRNLRVFRLLQTWGLLPVGASKTSQERHDLLDLLDLRILGSDWFQRKRIDNSIPEPMQVLPYLLRASALDEPLEPHFLGRALYHLAQRRGFLSNRKVSSRSKADDDSGLVKPAIADLRKQMLETGSRTLGEFFSRTSPSQARIRSRWTGRDMYEGEFTFIWDSQTVHHPTILTPERKKLLHKAIFFQRPLSSARHLIGTCELEPKHRRAPRSLLVSQRFRLLQRVNDLQIVLPGQPTRDLAPEERADVLNSLERKGDLTFPAIRKLLHLPKEAKFNLEAAGETRILGNRTNAFFLRLFGDRWDKMPSEERDQIVDYVRSFQRLDKLPTAAAKKWGLSEESAQILESDPLEPDYLNLSKAAMCKLLPLMEEGVPYAEARRQVYPQRFVSQAPQELLPPVFLAEASVGRIRNPSVVRSLTELRKVVNAVVRKFGKPKQIRIELARDLRNSRAQRERMAKSNRENEKLRADAAKRILKEIGNPGPSRRDLQKAQLWDECHGECPYTGKVISFASLFGPEPQFDIEHIIPFSRSLDNSFTNLTLCHAEHNRNVKQNRAPSEAYGSDPDTYQAILNRVRKFSSRSATEKLRRFLMTPEEIQNFVSDFAESQLNDTRYASRLASDYLGLLYGGRVDADHKLRIRATVGRITAILRDEWKLNAILNDGSTLQGGLTLKSRDDHRHHAIDAIVTALTDEGTIQTLSRAAENAYLAKRRRFAPIEEPWQGFFEDVRNEISRIVVSHRTSGRVRGPLHEQTLYSHPIPVAAGASGQKKPGKPGFEHRVRKPLESMTTEEAANIGDPVVRSLVAEKLAQFGGAVPKTVFSVPANLPVFQASDGRRIPIRRVRVRKPLTATVLGSGPSTRYVVPESNHHAEIFAELDQKGKEIEWDIFIVSLAEAIRRKHSRESVVSKNHGAQETFKFSVAPGDVIEMDVASGRRQYFVVRGTSYPSVSLAPIADARQKKELVKDHAYLRMVPNSLRKKNARKIHVTPLGDVEEAHD

SEQ ID NO: 7485 - protein, 1073 aa, unidentified
  REGION 1..1073: note = Description of Unknown:uncultivated organism sequence
MPAPLSSQDYILGIDLGVGSVGWAIVGTKDAQPSALVRAGVRVFAPAVEGNIESGREESRNVARRSARLQRRQTWRRSRRNLRVFRLLQTWGLLPVGASKTSQERHDLLDLLDLRILGSDWFQRKRIDNSIPEPMQVLPYLLRASALDEPLEPHFLGRALYHLAQRRGFLSNRKVSSRSKADDDSGLVKPAIADLRKQMLETGSRTLGEFFSRTSPSQARIRSRWTGRDMYEGEFTFIWDSQTVHHPTILTPERKKLLHKAIFFQRPLSSARHLIGTCELEPKHRRAPRSLLVSQRFRLLQRVNDLQIVLPGQPTRDLAPEERADVLNSLERKGDLTFPAIRKLLHLPKEAKFNLEAAGETRILGNRTNAFFLRLFGDRWDKMPSEERDQIVDYVRSFQRLDKLPTAAAKKWGLSEESAQILESDPLEPDYLNLSKAAMCKLLPLMEEGVPYAEARRQVYPQRFVSQAPQELLPPVFLAEASVGRIRNPSVVHSLTELRKVVNAVVRKFGKPKQIRIELARDLRNSRAQRERMAKSNRENEKLRADAAKRILKEIGNPGPSRRDLQKAQLWDECHGECPYTGKVISFASLFGPEPQFDIEHIIPFSRSLDNSFTNLTLCHAEHNRNVKQNRAPSEAYGSDPDTYQAILNRVRKFSSRSATEKLRRFLMTPEEIQNFVSDFAESQLNDTRYASRLASDYLGLLYGGRVDADHKLRIRATVGRITAILRDEWKLNAILNDGSTSQGGLTLKSRDDHRHHAIDAIVTALTDEGTIQTLSRAAENAYLAKRRRFAPIEEPWQGFFEDVRNEISRIVVSHRTSGRVRGPLHEQTLYSHPIPVAAGASGQKKPGKPGFEHRVRKPLESMTTEEAANIGDPVVRSLVAEKLAQFGGAVPKTVFSVPANLPVFQASDGRRIPIRRVRVRKPLTATVLGSGPSTRYVVPESNHHAEIFAELDQKGKEIEWDIFIVSLAEAIRRKHSRESVVSKNHGAQETFKFSVAPGDVIEMDVASGRRQYFVVRGTSYPSVSLAPIADARQKKELVKDHAYLRMVPNSLRKKNARKIHVTPLGDVEEAHD

SEQ ID NO: 7486 - protein, 1067 aa, unidentified
  REGION 1..1067: note = Description of Unknown:uncultivated organism sequence
MEQPCGEFVLGIDLGTNSVGWAMIGLVDGEPSKLLRAGVRVFDAGMEGDIESGQEQSRNLKRREARLHRRQLWRRARRLTKTFNLLRQFGLLPDGDPSTPEKRQDLINKLDQDIRGSEWFKAKAQSDAYPEPEQTLPYILRAAALDEPLEPHFLGRALYHLAQRRGFLSGRLRPAKKEDDEGAVKKGIGELRTAIEEKHARTLGEFFAQASPTERRIRGHWTARSMYEEEFEKIWAAQAPHHPTLLGDDRKKQISRALFFQRPLWFDPDTVGQCELEPGERRAPAYLLTAQRFRLLQKVNDLQIEEPDKAPRYLTPEERGKLSDALELQGDLPFHKDRKAEGRVVPSVRTLLGLPKNVPFNLQRGGEERMAGNRTTSAFYAVFGERWLDMSAEEHKQAILDVLSIHKPEALRRRALGHWKLDDPAADMFCEISLEPDYMNFSRKAIENLLPLLEQGVPLQAARKQIYPESFEARDAKPLLPPVEEAVREIRNPAVMRSLTELRKVVNSVVRRFGKPTYIRIELARDLKKSKKQRAVVSEINRRNEKARAKAAEEIVKGDVGIKEPKPEDKRRYLLAEECHWQCPYTGKTISMQALFGPEPQFDIEHIIPFSRSVDNSFQNLTLCYVPENRAAKGNRTPYEAYSGDPERHQEILDRVKRFTGERAMVSAKLKRFMMDEGDLEEFLADFRKRQLNDTAYAARLATRYVGLLYGGLADPEHQQRVFAPSGQTTAYFRNLWKLNGILNDGPSTGGGRVEKSRDDHRHHAVDAVVIALTDAGMVRRLSDAAQRASSAGRKRFAALEGPWPNFVDTVRERINGIVVSHRVSKKVSGALHEETIYSSPGADGSVRVRKPLAALTKSEAEEIADDGVKALVLSKLGGGDPKKVFASEENLPCFETPDGRRIPIKRVRIRKAVPTFTLGEGRAARHVTPESNHHVEIYAEVDENGKEGTWGGDVVPTDEAYGRVKMRKPIIQRDHGPLAKFRFSLAPGEVIECDDGRGGRSLWVVRGATSQRESPRLFLVPINDAREKAEVVKSGLYWRPFLNPLRKLNARKVIVSPLGEVSEAHD

SEQ ID NO: 7487 - protein, 1080 aa, unidentified
  REGION 1..1080: note = Description of Unknown:uncultivated organism sequence
MSASSVSCQKYVLGLDLGSASLGWAVVALNDANEPTHLIRTGVRIFEPGVEGTTADIAEGKDQSKAVDRRTARLHRRQLRRRAARQRDLFKLLQQQGFLPVQDEGSTSASEERHNILNDLDSRICAKWSANSDTDSFAQLPLYKLRKTALDEKLEPFEIGRILYHLSQRRGFKSNRRDTPKNADEEKEQGRVKTGISELQSAMEQSGARTLGEYLASLDPHKVGENVRRRWTSRSMYECEFNQIWEAQIAYYPESLTPALQKQIGLLLFFQRPIAAQGHLIGKCELEPNERRASWATLEAQRFRILQKVNDLQIIYPGNPISQPLTSPEREFVFNLLDSEGDQTFANIRKHLQLDKKSVFNLERGDEKRLRGNRTNVVMRQAFAERWGAFSEEERKQIVEEWRTSESDEWLAKRGVDHWGLGPEIAATWSTKHPENGYCALSRKAIARLMPLMSEGVSFKTAETQLYGDRFSGATALDQLPVVKQYLTTLRNPAVERALTEMRKVVNAIVREYGKPYEIRIELARELKKPRQERVSATKANRKRQKEREDIMQRILQECGIPKERQSRKDIEKALLHVECGGMCPYTGRSIRFSDLFHDSQFDVEHIIPRSRYPDDSFQNKTLCYLPDNRERKRNKTPFEAYGSNEQEWAEILERVRKFGNAGKLKRFMLETLKDIEDFSARQMNDTRYASVLAGRLLGTLYGGRDVQGDVGMRQAVFVSSGAVTATLRRSWGLEAILHDLVPDTSGQGKGKPRTDHRHHAIDAIVIALTRQGMIQQMARAASTEPWQDGERTWRKIESPWRDFVDSIRPHIAELVVSHRPEHKMSGELHKGTNYSVPHLHKGKLTVHTRCALSALCAADIAAEDVIVDVAVRDAIRKKLDELGGSPKLFEKVENTPYLAARDGRQIPIRKVRIRETKNALQIGHGATARLVASGGIHHVAMFVTRDKKRCEVWKSNVVQITDIYQKLPRHDRRKGRPKSPSQGPVVFRGFPDDPDAQFVFSLMKDDTVALDVNGQARIFRVKKFSDNGQIWFVPANDAHDNATQMKSGITWSKKPNTLKELHPRKVVVDLLGKVHTAND

SEQ ID NO: 7488 - protein, 1238 aa, unidentified
  REGION 1..1238: note = Description of Unknown:uncultivated organism sequence
MSPALDSSQKYILGLDLGSASIGWAAIRLNDQLEPTEVFDAGVRIFDPGVEVTAKISTEEAIMRGIDRSKAVGRRLARQARRQSGRKRARQNKLFKLLQANDWLPTYEEFRDEPLFAQKHLTFNRLDKELADALSGSRRRRGADAVMLDIDQALPYVLRKEALERELKPCELGKITYHLSQRRGYRPSAVDENDREESAEEEETASSSKKGKKKRETEDDGDEQSTGKVEKGISDLNTKMQAAYQTGTIKAPLIGPYFGTFIAHNPHDERIRHRWTAREMFEDEFDLVWAKQDEFYRTSHPGLTPEELEKREKLRQEIRKLLFFQRPLASTAHLIGFCDLEPEERRAPWASLEAQQFRLLQKVNNLRYFDRTDMLEKQLSEEKSAKLVMKLQEEGDQTFPAIRKLLDMPDAEFNLQKKRKPDDEPKKKINEGKIEGNRVNAVMLRVFGAERWDSFTWDEKVAIVESWRTTEGLKERERIAADQWSLDKFHAHIWAENRPPADYCKLSRKAILNLLDPAKGGMWNGVPFMTARLKVYPNPLAGKKPLDYVPEVTGPNGSIRSLTNPAVIRALTEVRKVVNAVIRKHDKPYEIRIELARELRKNRKQRKDTEEANEKNHERRLEAARRILQECKSYDPQGLDAEGLVRAKRDDVTKMLLLMECHCTCPYTGQSIGYSQLFGGEVEIEHIIPQSMMVDNSFDNLTLTFRGTNHEKLDRTPWQHFGGNQDDWENILKRVEKFGNKRKLALFQLLTPEQARKFGARRLNDTRFTSKLAGRLLMTLYGGRDVLPDAGVEVDEQDEFKDSTGRRAIFVSSGMVTALLRDAWMLNLHELIGDSATKTAETAHEKREKNKESKKKDRSDHRHHALDAVVIGLTTESLIRKINTLSASYYVQHQNDRYISLGYRELLKLVRREARPECLNGERLERLRDTFKGIVTSHRVNHRLRGELHKAGYFGKERGRTPKNDTPIRHKRISIRDLSKMEKPEDIESTIAHIVEGKNKDGSPNTTIKQIVREFGETIRGKNKKGEEVRGYRMWKEAEHRYPTLPGKRLGKPVPIKKFTTWFTKHTTSLGMENRGKGYPERNVETGEIAYVSFFNVQNRRGTKWKWDVVKLFDAAQSIQSVPKRERARTNIFALPSDEFKKSLRDDDEVTYRFSLMKGDLVEMENGEIVIVRRFESDGRIWISAVNAAGTDKMLNETNSLHRIGLSDFLKKRPKDSDSPQPIRIDPIGNKSRIELGA

SEQ ID NO: 7489 - protein, 1077 aa, unidentified
  REGION 1..1077: note = Description of Unknown:uncultivated organism sequence
MHTAPSEAPKYSLGIDLGSASLGWAMVCLNEANEPTELLRAGVRIFEPAVEGNVEKGQDVSNAAARRQARLARRQLRRRAGRQKQLFKLLQRQGLLPRYEGQAGDSAIQRHEILNALDRDLAAKWSNSVDPITSNFVELPLYVLRKTALDTQLQPFELGRIFYHLSQRRGFQSNRRASNKDKEEEQGKVKAGISQLEAEIKAAGAETLGAYFAALDPHSQKVRRRWTHRRMFQEEFEIIWERQRSFHPTLLTEELRREISRILFFQRPIREQANLIGHCELEPDQRRASWATLEAQRFRLLQKVNDLEIIYPGQVLGTSLTDAQRLSLYELLDAEGDQKFEAIRKHLGIEKNIGFNLQRGGDTKLRGNLVNKIMRKAFGERWEEMDDEQQRLAVDEWRTIEGEQSLRRRFVEHWGLDDLAASALAEQTPPKGHCQLSRKAIRRLFPLMMLGQRFMAARQEIPEYRPRLKEPLERIPPVRETLNNLRNPAIERALTELRKVVNAMVGEYGKPAEVRIELARDLKKSRAERAKATDIMRRREKERITAKERLLKELGPAFDHPSRADVEKALLWEECGGICPYTGRSIEFASLFGEAPQFDVEHILPLSRIPDDSFQNKTLCYHEENRNRKGNRTPFEAYGADPDTYGQIIGRVKAWKIGNPGKLRRFELRTLDEIEGFSSRQLNDTRYSSRLAMQLLATLYGGDRIPQQDSSNRQIVFASSGSVTATLRKVWGLEEILREAAPSANGQSRGKPRTDHRHHAIDAIVIALTRQGTIQAMNRAAEQAPSWMRTGRAYRGLQQPWRDFVPSTRPVIHGLLVSHRPEHRLTGELHDATNYGAPRKVSGKEVVHVRKPVSGLGVKDVESIVDTVVREAVRAKAKELDGDLSKCNPKEGVEDWPLLRTRNGKTIPIKRVRIQKSLEVETVANGSARERYVALSSNHHVAIFAELDGHGKERRWEPITVSLYEAMNRKRSGLPVVQQAYPGAEDCVFKFSLMGGDTALLHRDCDHARDICRPRAWRIRTITQTGRVALVPINDARMKAEIKSSKDWWEPGIDALRKLGCEKVVIDTLGRPHVTSD

SEQ ID NO: 7490 - protein, 1073 aa, unidentified
  REGION 1..1073: note = Description of Unknown:uncultivated organism sequence
MPAPLSSQDYILGIDLGVGSVGWAIVGTKDAQPSALVRAGVRVFAPAVEGNIESGREESRNVARRSARLQRRQTWRRSRRNLRVFRLLQTWGLLPVGASKTSQERHDLLDLLDLRILGSDWFQRKRIDNSIPEPMQVLPYLLRASALDEPLEPHFLGRALYHLAQRRGFLSNRKVSSRSKADDDSGLVKPAIADLRKQMLETGSRTLGEFFSRTSPSQARIRSRWTGRDMYEGEFTFIWDSQTVHHPTILTPERKKLLHKAIFFQRPLSSARHLIGTCELEPKHRRAPRSLLVSQRFRLLQRVNDLQIVLPGQPTRDLAPEERADVLNSLERKGDLTFPAIRKLLHLPKEAKFNLEAAGETRILGNRTNAFFLRLFGDRWDKMPSEERDQIVDYVRSFQRLDKLPTAAAKKWGLSEESAQILESDPLEPDYLNLSKAAMCKLLPLMEEGVPYAEARRQVYPQRFVSQAPQELLPPVFLAEASVGRIRNPSVVHSLTELRKVVNAVVRKFGKPKQIRIELARDLRNSRAQRERMAKSNRENEKLRADAAKRILKEIGNPGPSRRDLQKAQLWDECHGECPYTGKVISFASLFGPEPQFDIEHIIPFSRSLDNSFTNLTLCHAEHNRNVKQNRAPSEAYGSDPDTYQAILNRVRKFSSRSATEKLRRFLMTPEEIQNFVSDFAESQLNDTRYASRLASDYLGLLYGGRVDADHKLRIRATVGRITAILRDEWKLNAILNDGSTSQGGLTLKSRDDHRHHAIDAIVTALTDEGTIQTLSRAAENAYLAKRRRFAPIEEPWQGFFEDVRNEISRIVVSHRTSGRVRGPLHEQTLYSHPIPVAAGASGQKKPGKPGFEHRVRKPLESMTTEEAANIGDPVVRSLVAEKVAQFGGAVPKTVFSVPANLPVFQASDGRRIPIRRVRVRKPLTATVLGSGPSTRYVVPESNHHAEIFAELDQKGKEIEWDIFIVSLAEAIRRKHSRESVVSKNHGAQETFKFSVAPGDVIEMDVASGRRQYFVVRGTSYPSVSLAPIADARQKKELVKDHAYLRMVPNSLRKKNARKIHVTPLGDVEEAHD

SEQ ID NO: 7491 - protein, 1198 aa, unidentified
  REGION 1..1198: note = Description of Unknown:uncultivated organism sequence
MFINRKLVLGLDLGVGSIGWCLVSKDLQDNPLEIVAIGSRVVPLSTTEVNDFKVGKSKSPSQQKRLVKSFRRNIDRYQMRRYKLFSILKYLNMMPNVELMKAPLIELWSLRSRAATVGEKLSLEEIGRVLFHINQKRGPQFRIDDESTDTVYKEAVNHRHKVIRESKQTVGQYFYCKLQNSRITNPNGKSFYTYRIKDNVLPREAYEEEFMQIMDVQMKFYPEVLTPSIISRLFDTIFFQRELKSCKKLVSVCDIEKREYPIPDKEGQYRIVGPKVAPKSSPLFQVFKIWQSISNISFTDIDGQRLYIKKDVRNKLFNHILTKGKLNARDCYNIVGVSDKEFSLDKRTLDGIKGNLTLNQISKALSLLPVPKRNELLQFDLKVEEQVDTVTGEIHNVISNDMLSEPLYKLWHTLYSLNKADERRKCLQNNFGISDKQTIDELCKLNFKKDGYCKLSSKAIRRILPYLQEGYDYAQSCLLAGFRHSDYVTTEENEGRPLQTHLPILKKNELHQPVVEKVLNQMIGIVNRLIEKYGEIDETRIELARELQRSKKEREDMDKQNRENLKRNEEIAEKLKKENGINKPTHRMLMKYRQFEETGGKCMYCGGDIDLKTFMYGIDTEWEHIIPKALLFDNSFSNSICACQKCNKTKNDRTAYDYMRSLGTQRFNDYKERVKKMYDEKSISRTKYKNLLASFEDYQERKRNGCATEEDKELWENYIDRQIRQTQYISRAALKMLKNVCRNVYATSGTVTSFLRHGWGYDNILHDLNLPVYDAAGIGLTEDVVVKQDGKDIQVHRIKGWNKRMDNRHHAIDALVVACTKQSIVQRLNEFNSSRTEFEEEVKSGKKKRFKNKKSMLEKWVEINTPFSKKEVAEKVSGIIVSYRTSNKVASSSTNRYLSNGKTIVEKGIISPRLPLHESHLYGKINGKNVYRYSLSELFLKKKDVNIEDVLKSIVDKGIVAILENRINAGIINNDSSKKPYDVDPAKAKENLATLVSKPPMHSNGTPIRRVKCYVSKPTIPVRTDSHGTVTAYAVSGNNHHIEFYRNDKGEFKESVISYWQAFLRIKNYLPLFVNIDNASILRKASEEGFDIGEIHDSSWNPFLCLGKTELVVIGLKKRTIENLIKRGDYSKIASHVYKVCGVSQGDYTFCIHNEIKYVPKERNKPDGRFIRIQNIKSLANLELVKVKINPIGEITIL

SEQ ID NO: 7492 - protein, 1087 aa, unidentified
  REGION 1..1087: note = Description of Unknown:uncultivated organism sequence
MPESTVITQRYVLGLDLGSASLGWALIGIDAMGIPVSLIRAGVRIFEPGVDGSALEIQQGKDQSKAVDRRAERLRRRQLRRRVARQRELFGVLQGVGLLPTSASKVGVGSEARHQVLNDLDATLIQRYAKGSNKEAFSQMPLYALRKKALYEPLALDELGRVFFHLSQRRGFQSNRKDVKKKAKEDENQGQVKSAIHDLEQAIEASGAQTLGEYLAGLDPHEQKVRRQWTGRKMFEKEFEKIWDKQKEYHAALLTPELHDRIWNLLFFQRPVSDPTISRKLVGKCELEPGERRAPWASLPAQEFRILQKVNGLKLIGNGAELALNEDGRAAFLALLEKHESRSFQQIKKHLGLPEETKFNLERGAGKNPGLQGNRTLQSMRRVFSDSWNAFSPGKQNQIIENWRNSEKDEDLKREAMEHWGLDEDAADRLVKESPAKDYCALSLKALNNILPLMRQGIPYMTAKTQIYGDGFSGATVHPLIPVLRPSRGHHFGPNPPARDPFLEKIANGLRNPAVERAVAEMRKVVNAIVREHGKPYEIRIELARELKKPRSERAKETTKNRDREAANKKLAERMLRECGLQNPSRADFERAKLWFEQNEGECPYTGHRLPFNRLFDDSNGWDVDHILPRSRVPDDSYQNKVLCVADINRRVKGNKTPYEAFSADADSWNNEILFRVKQWKNPGKLKKFEMDSTTKLEEFSSRQLNDTRYTSLIAARLLSTLYGGRDIIDNGKKRQVIYSSTGAITATLRRNWGFEEILRGIVVPEKGEQFGKPRTDHRHHAVDAIVIALTRNNVLNAMAQASALEPWQQGTRSWRRIPQPWQSPNFFESVRRQIDEMLTSHRQEHKVSGKMHDGTNYGRPTLYKGEWTVISRKPITKLSKEDIEAEEVVVDKAIRDALRIKLNELGGNPKAFEKPENIPYLTSKNSDKKIPIRKVRVHETRNPITVGKGPRERFVYSSEIHHVELFVTRDTKRREKWDSRVVQITEAYERRRSKKAVVSRALADDAEAEFLFSLAKDDTFEIKDRDGRKIVRVKSFYDNKQIFYVPVNFAGIGRVEDESKKPNTLKPLEARKVVIDLLGRVHPAND

SEQ ID NO: 7493 - protein, 1238 aa, unidentified
  REGION 1..1238: note = Description of Unknown:uncultivated organism sequence
MSPALDSSQKYILGLDLGSASIGWAAIRLNDQLEPTEVFDAGVRIFDPGVEVTAKIPTEEAIMRGIDRSKAVGRRLARQARRQSGRKRARQNKLFKLLQANDWLPTYEEFRDEPLFAQKHLTFNRLDKELADALSGSRRRRGADAVMLDIDQALPYVLRKEALERELKPCELGKITYHLSQRRGYRPSAVDENDREESAEEEETASSSKKRKKKRETEDDGDEQSTGKVEKGISDLNTKMQAAYQTGTIKAPLIGPYFGTFIAHNPHDERIRHRWTAREMFENEFDLIWAKQDEFYRTSHPGLTPEELEKREKLRQEIRKLLFFQRPLASTAHLIGFCDLEQEERRAPWASLEAQQFRLLQKVNNLRYFDRTDMLEKQLSEEKSARLVKKLQEEGDQTFPAIRKLLDMPDAEFNLQKKGKPDDDPKKKINEGKIEGNRVNAVMLRVFGAERWDSFTWDEKVAIVESWRTTEGLKERERVAADQWSLDKFHAHIWAENRPPADYCKLSRKAILNLLDPAKGGMWNGVPFMTARLKVYPNPLAGKKPLDYVPEVTGPNGSIRSLTNPAVIRALTELRKVVNAVIRKHDKPYEIRIELARELRKNRKQRKDTEEANEKNHERRLEAARRILQECKNYDPQGLDAEGLVRAKRDDVTKMLLLMECHCTCPYTGQSIGYSQLFGGEVEIEHIIPQSMMVDNSFDNLTLTFRGTNHEKLDRTPWQHFGGNQDDWENILKRVEKFGNKRKLALFQLLTPEQARKFGARRLNDTRHTSKLAGRLLMTLYGGRDVLPDAGVEVDEQDEFKDSAGRRAIFVSSGMVTALLRDAWMLNLHELIGDSATKTAETAQEKREKNKESKKKDRSDHRHHALDAVVIGLTTESLIRKINTLSASYYVQHQNDRYTSLGYRELLKLVRREARPECLNGERLERLRDTFKGIVTSHRVNHRLRGELHKAGYFGKERGRTPKNDTPIRHKRISIRDLSKMEKPEDIESTIAHIVEGKNKDGSPNTTIQQIVREFGETIRGKNKKGEEVRGYRMWKEAEHRYPTLPGKRLGKPVPIKKFTTWFTKHTTSLGMEKRGKGHPERNVETGEIAYVSFFNVQNRRGTKWKWDVVKLFDAAQSIQSVPKRERVRTNIFALPSEEFKKSLRDDDEVTYRFSLMKGDLVEMENGEIVIVRRFESDGRIWISAVNAAGTDKMLNETNSLHRIGLSDFLKKRPKDSDSPQPIRIDPIGNKSRIELGA

SEQ ID NO: 7494 - protein, 689 aa, unidentified
  REGION 1..689: note = Description of Unknown:uncultivated organism sequence
MAIYNEIRVELARELKQSKDERNSAYLNNSKRERENKVIEERIREFGIRPSRTRIQKYRLWEEAKHICFYCGQPVGVKEFLEGAEVEIEHIIPRSLFFDDSFSNKVCACRKCNAEKGNQTAFDYMKQKGENAFKDYTRRIEDAFEKKEISKTKRERLMTAAKDIPEDFIDRQLRQSQYISKKAVEMLKQVCRNVWTTSGSVTDFVRHQWGYDNILHNLNFDRYKAAGLTETVTFDHHGQSHQEERIKGWSKRLDHRHHAIDALTIASTKQSYIQRLNHLNASRDKMFQELEAQSEDVKEKFSLLEKWMKERPHIPVTEVSNAVEGILVSFKSGKRVATPGKRYTYKNGKRTVAQDGIIVPRGALSEDSVYGVISCLEKNVSVKKIFEHPETIFKSYIREKVEDRIKEFDGDWKAALKSLKKDPIYLGVNETKPLEYATCWKKEFVIRYRLSGIKKKDIEYIVDQHVRKLVAERIDAVGEKDAFKEPLFADKAGKAPVNSVRLFTGLSAVEPVKYENGTPIGFAKPGNNHHIALYRDAEGKLTEHVVSFWHAVERKKYGIPVVVEDTNALWDKIVNMDLPDAFMNNLPPAGLKLEVSIQQNEMFILGMAEEEYRRAMEEKDYKMLNKYLYRVQKIASKEYYFRFHIETVLDDSLEAMSIHKFYRVKSLGAFSNLHPHKVRVNILGEISEL

SEQ ID NO: 7495 - protein, 1030 aa, unidentified
  REGION 1..1030: note = Description of Unknown:uncultivated organism sequence
MILGIDIGTSSIGWALLATDSDVSPNRIVDAGVRIFPAGVDGDIDSGREKPQNLKRRDARSARRLGWREGRRHRRCVSILQSMGLLPKTADLKPPTLNQMFQELDTQLRPADIDHRETITWLYHLRARALDERLEPHELGRAIIHLFKRRGFRSNRKDQTNADEDLGQVKAAIRDLAEAMETASHRTVGEHFASVDPEQQRIRARWLGRDAIQGEFDAIMKAQAVHHESLQTELAVELRRAAFYQRPLKPVKPGRCSLEPDLYRARMASLNAQRFRLLQDVANLQVLNDGPPRPLSPEERTELIAALEETPKLTWAATRKTLGLPKTVTFNLEEGGKTNLIGNRTASALREAFKASWDDMNSEDREQAVEDLLAFEKTDALRRRARRHWNLDPDSADLFTSIQLEPGYANHSEEAMERLIPDLEQGVHYSTARKRRYPESFLTDEPVDALPPVKDFDPELANPTVSRCLSELRKVVNAVIARHGKPERIRVELARDLKRGRADRQRMTRDNVRRGRDRDETRNTIRTETGIAHPNRADVTKARLADECNWMCPFTGRSFGWMDLFGPNPSMDVEHIIPFSQSLDDSYLNKTLCLHEENRNVKKNRTPFLAYGSTDRWDEMLDRVGRFKGDAARAKLQRFITEDAEGEIFDDFSSRQLNDTRYASRLAMDYVGMLFGGRSDANHTLRVQATTGGLTAHLRRGLQLEGLLSDTGNPFKNRSDHRHHAVDAVVIALIDPGMVHRMARQADKAWQRGERRSLTPVQEPWPGFMADVRAKIEGIVVSHRSNGRLAGALHEETNYSKQRDSGKGIRRTVRKAIADLTENEIEKIADPPLRSLIKRELESRGGPPKKAFAETASPLVMTGRDGRPRTIRRVRITKPGEVAMIGPEHARRWVKPGSNHHMAIHEVQAENGPKWEATVVTLLEATERRRRGVPVIERVTDGSHRFICSLRSGDSVVVEIENEGDVFCTVNSVSGSKIEITRHADARLVSEIRKMGVKGGRLEISLKKLRSIFKDKADVLPDGSVRTRRD

SEQ ID NO: 7496 - protein, 1030 aa, unidentified
  REGION 1..1030: note = Description of Unknown:uncultivated organism sequence
MILGIDIGTSSIGWALLATDSDVSPNRIVDAGVRIFPAGVDGDIDSGREKPQNLKRRDARSARRLGWREGRRHRRCVSILQSMGLLPKTADLKPPTLNQMFQELDTQLRPADIDHRETITWLYHLRARALDERLEPHELGRAIIHLFKRRGFRSNRKDQTNADEDLGQVKAAIRDLAEAMETASHRTVGEHFASVDPEQQRIRARWLGRDAIQGEFDAIMKAQAVHHESLQTELAVELRRAAFYQRPLKPVKPGRCSLEPDLYRARMASLNAQRFRLLQDVANLQVLNDGPPRPLSPEERTELIAALEETPKMTWAATRKTLGLPKTVTFNLEEGGKTNLIGNRTASALREAFKASWDDMNSEDREQAVEDLLAFEKTDALRRRARTHWNLDPDSADLFTSIQLEPGYANHSEEAMERLIPDLEQGVHYSTARKRRYPESFLTDEPVDALPPVKDFDPELANPTVSRCLSELRKVVNAVIARHGKPERIRVELARDLKRGRADRQRMTRDNVRRGRDRDETRNTIRTETGIAHPNRADVTKARLADECNWMCPFTGRSFGWMDLFGPSPSMDVEHIIPFSQSLDDSYLNKTLCLHEENRNVKKNRTPFLAYGSTDRWDEMLDRVGRFKGDAARAKLQRFITEDAEGEIFDDFSSRQLNDTRYASRLAMDYVGMLFGGRSDANHTLRVQATTGGLTAHLRRGLQLEGLLSDTGNPFKNRSDHRHHAVDAVVIALIDPGMVHRMARQADKAWQRGERRSLTPVQEPWPGFMADVRAKIEGIVVSHRSNGRLAGALHEETNYSKQRDSGKGIRRTVRKAIADLTENEIEKIADPPLRSLIKRELESRGGPPKKAFAETASPLVMTGRDGRSRTIRRVRITKPGEVAMIGPEHARRWVKPGSNHHMAIHEVQAENGPKWEATVVTLLEATERRRRGVPVIERVNDGSHRFICSLRSGDSVVVEIENEGDVFCAVNSVSGSTIELTRHADARLASEIKKMGVKGGRLAISLKKLRSIFKDKVDVLPDGSVRTRRD

SEQ ID NO: 7497 - protein, 1041 aa, unidentified
  REGION 1..1041: note = Description of Unknown:uncultivated organism sequence
MSKVKQSKKILGLDLGSNSLGWALIEYDQNSSGKIIDNGVRVFEAGMKGDIERGKAESRNKKRRENRLTRRQYNRRRRRKLRLVLQLKEAGLLPLEFDLNLFFNKLDYDLYKKFFPDYNTKYFSHIIPYFLRARALDYKLNDFELGRVFYHLCQRRGFWSNRKSPLKKDEDLGIVKRNIGELWKKISESGSRTLGEYFSRLNPETEKIRGRYTSRQMYKDEFDLIWKKQQEFGNEKLTANLHKKIFKTIFFQRKLKTQKGRIGACTFETDAKRCPWYRFEAQSFRLLQNVTNLRIQEYNGGRRELTSEERKLLIDLLEENASLTYAEARKLLGITNKKTKFTIEIDTEGEKKIKGNRTNAELKKVFSEKWNIFSMKDKEKVVHALISFEKDTPLKKYAIKKWGITEEKAEELAEIRLEEGYCNLSLKAIKKLIPKLDEGLNYYEALQKVYGETQVKSEILAELPVVREAIGDVRNPVVNRCISELRRCVNPIIKKYGKPDEIHIELARDIKTSNKQKERFIKIINYNEKLNIDAKKYLEERGIKNPSREDIIKYRLWVECKEQCPYTGRSIGFNDLFGDLPQFDIEHIIPYSICLENRFENLTLFYNEENRKVKHNKIPFETYYGNPEKYEEILSRVKGFNSRADIKFDKYKRFTAENTEDYADYASRQLNDTRYASRIAVDYLGLIYGGVIDQNSKRRIYAVSGGITAILRNYMGLNFVLGGGVKSREDHRHHTIDALAIALATSGNIQGFSHYAQKFENIGRVYFKYQFEPWKGFLNEVISKVNNIITVHHVCQKVRGAMHEDTFYGKGIKEGTIHLKRPLKDMKENEVDEIVDPIIKKIVKDKLLELSYIDSKNKDPKKAFSIPENLPFMRLKSGDVKTIKSVRICRNQKVTVVGKGAKERNVVLGNNHHMEIVAILYEKANETKWEGHIVSLYEAYQRKKKGEPLIKKDFGEGKLFKFSLSCGDYIELDDNGKRDIYLIRSIPESLQIQYVKPNDARKQKDRKTDKAWLSKYPEPMRKANCKKLTITPFGELRYAHD

SEQ ID NO: 7498 - protein, 1040 aa, unidentified
  REGION 1..1040: note = Description of Unknown:uncultivated organism sequence
MKRNEIHAELVLGLDLGTNSVGWALIRAERGAIAGIVDAGVRIFSAGVNIDPTSGKNESRAVDRRRMRMMRRQLARKKVRRQTVLRLLTAAGLLPSGEAPARQPKKGDFSAWKKLLSVNAYELRARALDEKLEPLELGRALFHLAHRRGFKSNKKESARTQAKADGKDDLKGLKGEIKSLDDAIRSTGCRTLGEYFSKNLDLERRVRTRHTSRKMYREEFDLIWAKQSGYSPDILDEKLRKALVRAIFYQRPIPSQKERVGKCELEQAKRRCAQALLHAQESRLLQDLNHLELVWPNGEQAPLSTDQRAKLLALLETSERLTFSKARKEIGIKKSTGIEFNLEKGGREDIKGNVTAARIREVVGARWDGADEVLKADMVDTLMGMENEDAIARRARKAWGFDDELADDFSQICLEDSYAGHSSKALHKLLPHLRNGLPYAQAREQAYPNKAWRTAEIHDELPPCENLRNPIVQRTLAEMRRVVNALIAEYGKPGKIRIELARDLKQSVKNREADWKTMRSREKQRNAARKALIEQVGMKNPKPRDVEKWLLYEECGRVCPYTGKSIGASALFGDNPQFDIEHIIPFSRSLDNSFANKTLCEVAANRNEKKNQTPFEAYGQTERWNDILLRVTKFSGEYTKEKLRRFMLEKVAGESEFMADFASRNLNDTRYASVKAAENLAVLYPPDERLARIQVSTGRTTSLFRAAWGLNRILGSGDAKSRDDHRHHAIDAIVIALTTPGMTHELSLAASRSWLTTGRAGTFTDMQEPWPGFEEAIRQAIGRIVVSHRVDRHVNGQLHQETFYGQIRLAGGERWVIRKFLARLTEAEIVSGAIVDPAVRKAVEAKLAETGLKPDKCFQNGQNTPCLVAKGGRKIPIRKVRVLQSVNPVTLAPGTAKARHVVSGNNYALEVFACKDKTGKAALRTHVVSRREAMQRLRQIRNSRQGTVIRRQDEEGNPLRFSLVIGELIKVKWKGEEVICLVQGISPDFYSIRRHSDARPETVIRQQRDRMIIQSDATFDKLVSDKLAIDPIGRTHVSHD

SEQ ID NO: 7499 - protein, 1040 aa, unidentified
  REGION 1..1040: note = Description of Unknown:uncultivated organism sequence
MKKSEIHDELVLGLDLGTNSVGWALIRVERGAATGIVDAGVRIFAAGVNVDPTSGKNESRAVDRRRMRMMRRQLARKKVRRQTVLRLLSAVGMLPSEEAPARQPRKGDFTAWKKLLSVNAYELRTRALDEKLEPFELGRALFHLAHRRGFKSNKKELARSQAKPDANEDLKGLKGEIKSLDEAIRTTGCRTLGEYFFKNLDLERRVRTRHTSRKMYREEFDLIWAKQAGYAPNLLDEKLRKALVRAIFYQRPIPSQKDRVGKCELEPGKRRCAQALLHAQEARLLQDLNHLELVWPNGEQAPLDADQRAKLLALLETSERITFSRARKELGIKKSTGIEFNLEKGGREEIKGNVTAARIREVVGARWDEAGDALKADMVDTLMGMENEDAIAGRARKAWGFDDEMADQFSQICLEDSYAGHSSKALHKLLPHLRNGLPYAQAREQAYPNKAWRTAEIHDELPPCENLRNPVVQRTLAEMRRVVNTLIAEHGKPGKIRIELARDLKQSAKNREADWKAMRSREKQRKAARKALVEQVGMKNPKPRDVEKWLLYEECGRVCPYTGKSIGASALFGDNPQFDIEHIIPFSRSLDNSFANKTLCEVAANRNEKKNRTPFEAYGQTERWNDILLRVTKFSGEYTKEKLRRFMLEKVAGESEFMSDFASRNLNDTRYASVKAAENLAVLYPPDERLARIQVSTGRTTSLFRSAWGLNRILGGGDAKSRDDHRHHAIDAIVVALTTPGMTHELSLAASRSWLTTGRAGTFTDMPAPWPEFEEAVRQAIGRIVVSHRVDRYVNGQLHQETYYGQIRLAGGERWVIRKALSKLTESEIASGAIVDQAVRKAVEGKLTETGLKPDKCFQNGQNTPYLVAKTGRKIPIRKVRVVQSVNPVTVAPGTGKARHVVSGNNYALEVFACKDKNGNPAWRTHVVTRREAMRRLRQIRNSRQGSVIRRQDEEGNPLRFSLVIGDMVRMRYGNEMMTCRTQAISIRDYVFREHSDARDEKTVKQLKQRIRFRSDTALKDAVENKLAIDPIGRTHVSHD

SEQ ID NO: 7500 - protein, 1081 aa, unidentified
  REGION 1..1081: note = Description of Unknown:uncultivated organism sequence
MKRCLSRTKSTYYELRDKRRSDTLKDRIILSLTFFKGPPMKQMGHFPPYLLGIDLGISSIGWTLINVNKQGEPASIGKSGVHTFEEGVEGDVESGRDKARGSNRRDARMARRMIWRRQYRRKKLLRLLQRAELLPPGEISSPQSIHEYLLGIDAQLRQVYNPSKDRVTSHVIPYSLRAKALDEKLDPYELGRAIYHLAQRRGFLSNRKSLKKDEDEGVVKQGISDLRVAIDSAEARTLGEYFAGLDAETEKIRRLWTARSMYIDEFNRVWQSQSPHHPHLLTESLKKEVFQAIFFQRPLKSAKHLIGRCELMPNARRAAIADRLFQEFRILQKVNDLVVIPENGPQRPLTDAERDKLLAALRSHGDLTFARIKGKSILGLPKSTTFNFEQRDDEKKLPGNRTDEKLREVFADRWKTLTDSQKDEIVLEIISFQNPDALARRAIKAWALNESQARALADTRLEQGYASHSRKALRMMIEHMKNGTQYATVRRELFPDSFESREPVHRLPPVLKWKSSLRNPAVTRALTELRKLVNEIVRVFGKPEQIRIELARDLKRGRKERERKSKEITAQTKLRDQARVKIFKEAGISEPRSSDIEKALLWEECGGVCPYTGRGIDFASLFGANPQFDIEHILPFSRSLDNSFINKTLCYHEENRARKLNRTPFEAYGQDTARYDQILGRVRRFQGKAALAKLRRFEMQQIPEDFVNRQLSDTRYASRVAADYLALLYGGRTDATGSQRVQVSTGGITAHLRREWLLNSILGQGEKNREDHRHHAVDAIAIALASPMLVARLQRAAEHASEEGRRLFARVPEPWVGFLEQARREIEAVNVSARQTKRIAGELHEGTNYSPEFKWLEGKKERTGHHVRKAVHGITASQANDIVDPIVRERVIQWLKAQPSGKPAVDSFPVMKTRDGREIPIKRARIRKAMTAVPIADGPRKRYVKPGANHHSVIVAVIKPNEVETKWEDYPVTRLEAHGRKTNGSLIIQRDWGVNRRFKFSLTANDYVQMKVGDNPSELCRLLSLSEGQFEFRVHTDARKASEARKAGSGARIRTSADELRKRSAMKVRITYLGDIVPAND

SEQ ID NO: 7501 - protein, 1044 aa, unidentified
  REGION 1..1044: note = Description of Unknown:uncultivated organism sequence
MKKANESLVLGLDLGTNSIGWALFGFDGDNPVRLVGMGSRIFEAGTEGDIEAGKDESRGVARRMARQIRRQGERRARRQSKVGRVLQAMGLLPEGDIDHSQARHEYFATLDRTLRARHKKVNLEALPHVFPYWLRARALDNPLERDELGRAFYHLGQRRGFLSNRKAAGKKDEEKSVVKQGIAELAAAIHETGARTLGEYLSRIDPSDPDQRRIRERWTARQMYEDEFNAIWDAQSKHHPEVLTPEWRKILHNALFRQRPLKLQHDLIGACPLEPDRKRAPMALPAAQRFRVLQKVNDLRVIAPDYSERPLNPEERTLLLDALDRQEEMTFGKLRKLLNLKAYVFNLENGGEEKLIGNRTSAKMYGIFGERWFRFTPAQREAVIQDIRCFEKDAALAKRGREHYGLDEETAKRFGEIELEDGYCSLSRQAIEKLLPLMEKGIAYKTAEKEVYGDPGPAIAVEFLPCVAEAVRQQLMPVLRNPVVNRVLTELRKVVNAIINKYGKPDKIRIELARDMKKPRQERMKISRKMRDNEKSRQKAAKRIFEEMGVQNPSRDDIEKVLLAEECEWRCPYTGKTISMRTLLGDAPQFDVEHIIPFSRCLDNSFNNKTLCYHEENRSVKRNRTPHEAYGGDPARYQEILDRVAKFKGEGRDAKLRRFQMADLEDFEDFSARVLNDTRYASTLAAKYLGLLYGAEYRKHIQVSTGVITKYLRDCWGLNKVLGDGGEKNREDHRHHAVDAVAIALTSPKTVKMLSDAAKHATEERRRQFGKVPPPWDRFLQDIQEAAGQIVVSHRVARKVNGRMHEDTFYSPQPSSEPAKPCVHVRKRVEALSKGEIEAIVDPIVRRQVKQRLDELDSDDPKKAFATAEKHPFIETSDGRRLPIHKVRIRKNAATFKIGKEHRVRHVTTDSNHHVEIIETTDKRGNVKWEGSVVSRYEAMRRLQNREPVIKRDHGNGRKFLFSLALNEVVQMKDTEGVIRLYRIAGVSQFSTGTVVIDFRETGDARRAADVPREGRTRTPEAFRKSEPVKMCVTPLGELRRAND

SEQ ID NO: 7502 - protein, 1041 aa, unidentified
  REGION 1..1041: note = Description of Unknown:uncultivated organism sequence
METPTRRPFVLGLDLGARSVGWAVVDLQEGEPTGLRAAGSRCFEAGVSGSIDEGRDEARGQQRRQARQVRRQLARRQLRRTQLLRTLVANGLLPPLEGFDSLAIHRYLAAFDQGLRSRHLSADDRVGHQVLFYRLRTRALDEVLELHDFGRVLYQFGQRRGFLSGRKRRMKEGEEEGLVRKSIAALAEEMQAAGARTLGEYLAGLDPFTQRLRARWTARSMYEQEFAALWASQARFHDALTDGLRKKLAEVFFFQRPLKSQKGRVGECDLVPGRKRAPLACREAQRFRILQAVNNLRVARPGESEVELSPDERKRLLEALTAKGDLTFARVRKVLGLPKETEINLERGGEKRLVGHRTDAKMAAAFGARWEALGEPERDRIVDEVLSMEDPEALGRKAEKVWGLDPAAAAVLRETTFEPGYAAFSRKALRQLLPAMEAGEAVETARRRLFPEAVAARPAIGSLPRVEEALPALRNPAVARALTELRKVVNAIVRKWGVPEVVRIELARDLRNSRERRYRMARENRERETSREKAREEIRRSTGIAAPSRSDIEKYLLAEECGWECPYTGRRIGMTELFGEHPAFDIEHIWPLSRSLDNSFLNKTLCFHEENRERKRNRTPMEAYGNDTARFEQILARVGQFRGSARFVKLARFAADEIPSDFTERQLQDTRYATRMAMRYLGTLYGGTVDADGRRRVQAGAGGLTAIVRNELGLNSILGDGGLKSRDDHRHHAVDALAIALLDPGLVQRLQRAAERAPSHRRRHFAPLDPPWEGFLPEVQRVVDEVVVSHRTGRKISGALHKETNYSREIRTLDENGGIRWVRRLRRPVHLLTARQVEKIADHAVREAVRRKLEEVGGKADRLEEDPPVLEQPDGRRIPIRRVRVEESVNPRRVGSEGRERHVETDANHHMAIFARLDADGAEVAWEAEVVSQLEAQRRLRSGEPVIRWETEPGRSFKFSLSPGDTIELELNGVRRLLHVRSVWMEGETGRIACVNLADARQIADLRKASSWFRPMLSGLRSGGCRKVEVSPLGEVFPAGG

SEQ ID NO: 7503 - protein, 1062 aa, unidentified
  REGION 1..1062: note = Description of Unknown:uncultivated organism sequence
MNEKNVEKILGLDLGANSVGWALIEYVGGTPQRIVGMGSRIFDAAVEGDLEKGQEESRAVERRMARQLRRQHKRRVMRMIRVGELLQQAGWLPAGNLRDSVERDRLFKELDKVLREQYATRGFNPSGTDAIRGIAYFLRARALDEPLQPYALGRALYHLAARRGFLSNRKAAAKKDEELGKVKEGITELKQQIEETGARTLGEYFYHVDPVEEKRIRQRWTAREMYQDEFDQILARQVELGAIQDNPKFFRKLRKAVFRQRPLKSQRGLIGPCQFEEKEKRAPWHCLLAQEFRLLQKINDLRLISPTYEERPLSDEERLKLYHHLMENATGSFTELRKLLGLRAKDGWRFNLEAGEETKLKGNEVAARLIGVFGEDRWRAMSDQEKNQLISELNSDITDKTLERRAREVWGLEDHEKLEQLKSISLPTGYCALSRKALKKLVPLMRAGMPYETAVRETYGDLRFKKQTFDRLPPFLKIDRTLRSPVVIRTLSETRKVVNEIIRVFGRPERIHLELAREMKQSRERRKKRASEMRDREKQREMAIDKIQKNTGIDRHRISRRDVDKWLLAEECGWVCPYSGRSINYHNLFGRTPEFDIEHIIPYSKSLDDSFANKTLCHREWNLRKGNRTPAQAFKDTPEWEAMLQRVRSFKPLHAVNRSDISRGGQNRVDPYVQSKLHRFQMEEIPRDFVDQKLNDTRHAAKVARAYLELLYPPEERLKRVKAFSGAVTAELRKCWKLNSILGDPESPDPIKNRADHRHHAIDALVLALATQRMVQDLSNAVEKQLQCQRSIRGYQKWVDERWPGFLKDVRNAVAAIVVSHRVDHRIQGRLHNETFYSPPRQDENGKTYHLVRKPLDGSFDAGKVERIEDRAVREIVRKHLEDHGNDPKKAFNEPANHPRINNIPIHSVRIRDYVSPIPVGKEFCPRYVLTDSNHHMEIIEEQDRKGNPVWRAVVVSRYEAMRRKASGQPVVQRDHGEGKRFVCSIASGDTFSFQENGGTVLAIARSISDQNIEFVTINDARLKADIKKAGDWKKRSVNAFRTMCFQKVMISPVGEVYPAHD

SEQ ID NO: 7504 - protein, 1044 aa, unidentified
  REGION 1..1044: note = Description of Unknown:uncultivated organism sequence
MKKANESLVLGLDLGTNSIGWALFGFDGDNPVRLVGMGSRIFEAGTEGDIEAGKDESRGVARRMARQIRRQGERRARRQSKVGRVLQAMGLLPEGDIDHSQARHEYFVTLDRTLRARHKKVNLEALPHVFPYWLRARALDNPLERDELGRAFYHLGQRRGFLSNRKASGKKDEEKSVVKQGIAELAAAIHETGARTLGEYLSRIDPSDPEQRRIRERWTARQMYEDEFNAIWDAQSKHHPEVLTPEWRKILHNALFRQRPLKLQHDLIGACPLEPDRKRAPMALPAAQRFRVLQKVNDLRVIAPDYSERPLNPEERTLLLDALDRQEEMTFGKLRKLLNLKAYVFNLENGGEEKLIGNRTSAKMYGIFGERWFRFTPAQREAVIQDIRCFEKDAALAKRGREHYGLDEETAKRFGEIELEDGYCSLSRQAIEKLLPLMEKGIAYKTAEKEVYGDPGPAIAVEMLPSVAEAVRQQLMPVLRNPVVNRVLTELRKVVNAIINKYGKPDKIRIEIARDMKKPRQERMKISRKMRDNEKSRQKAAKRIFEEIGVQNPSRDDIEKVLLAEECEWRCPYTGKTISMRTLLGDAPQFDVEHIIPFSRCLDNSFNNKTLCYHEENRSVKRNRTPHEAYGGDPARYQEILDRVAKFKGEGRDAKLRRFQMADLEDFEDFSTRMLNDTRYASTLAAKYLGLLYGAEYRKHIQVSTGVITKYLRDCWGLNKVLGDGGEKNREDHRHHAVDAVAIALTSPKTVKMLSDAAKHATEERRRQFGKVPPPWDRFLQDIQEAAGQIVVSHRVARKVNGRMHEDTFYSPQPSSDPAKPCVHVRKRVEALSKGEIEAIVDPIVRRQVKQRLDELDSDDPKKAFATAEKHPFIETGDGRRLPIHKVRIRKNAATFKIGKEHRVRHVTTDSNHHVEIIETTDKRGNVKWEGSVVSRYEAMRRLQNREPVIKRDHGNGRKFLFSLALNEVVQMKDTEGVVRQYRVAGVSQFSTGQIVIDVRELSDARRAVDVPREGRTRSPDTLRKSESIKFCATPLGELRRAND

SEQ ID NO: 7505 - protein, 1069 aa, unidentified
  REGION 1..1069: note = Description of Unknown:uncultivated organism sequence
MDSVAKYTVLGLDLGSNSVGWALIEYRDGQPSALTGCGVRVFDAGTEGDVESGRDSARGVERRDARQRRRQCERRGRRLENLAGLLSRNGLLPKGAMRKPAERHRLLQALDQEIDARYRNAAPPDEKTAAALDQLPYFLRSRALDHPLEPHEFGRALYHLAQRRGYLSNRKSGKKDEDKGTVELNISELRERMSAAGVRTLGEFLAQVDPVNERRLRQRWTARDMYLDEFEAIWAAQQPHHPRLLSDALKKQIAEAIFYQRPLKSQKGLIGVCDLVSQKKRAPKALLISQRFRMLQKVNDLEVIFADESHRRLTEDERHAVLQAMEKKDEITFPQIRTAAKLPKGVEFNFQRGGEKDLPGNKTATALRAVFGEQWDRFSRETQDAIVGEAMGIERAETLERRGRDAWGLDPEAAAAFGKVHLESGYMALSREAMRAILPLMEQGIQFATARDQAFEGNWARNVLDQLPGVAEACKTIRNPVVMRTLTETRRVVNAIIRTYGKPDYIRIELAREMKKSRDERKKITAEIQKRRKANDALRQKIIDTTGDPRVTGRDLLKARLWEECGGLWKECGGRCPYTGKSIPFHELFSQDSPWDIEHIIPFSRCLDDSFFNKTLCYHEENRNVKQNRTPREAYEHSGHWDDILDRVARFQGDAAREKLRRFQMSTEDLLEFEEFSARQLNDTKFASREARNYLAWLYGPEAQSRIQASRGQITSYLRSAWRLNSILGDGGEKVRGDHRHHAVDAIAIALTDRATVKALSDAAASQFRERGRSRGFEKRMTEPWAGFLEDVQRAIDGVVVSHRPSRKVAGSFHEDTNYSPPRTDREGKPYVLVRKPLKKDFKAADIQNIADPTVRDIVWQHFRDHDEDSDAAFSNSANHPRIRIKDGPRAGQAIPIHKVRLKYTRDVTPIGHGPTERHVWTRGNSHIEIFEVLGKDGNVTKWQGRVVTRLDACQRRKQGQPIVNRHWDESRRFLFSLTQRDVVEIDVETTPGGLRRELYIVRGVSMEKDGRLELMHIHDARRKADVPRSATDDEKVRIRIAPFVSSLKKRNCRKAMVTPLGEVYPAND

SEQ ID NO: 7506 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLNNENIRGNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQIEEPWEGFLPEVQEMADTLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7507 - protein, 1038 aa, unidentified
  REGION 1..1038: note = Description of Unknown:uncultivated organism sequence
MLGIDLGTNSIGWAMIRLEDTLPVELMDMGVRIFEAGTTGDIESGKDESRAIERRAARQRRRQTDRQSRRLRTLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMDNLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQLEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7508 - protein, 1045 aa, unidentified
  REGION 1..1045: note = Description of Unknown:uncultivated organism sequence
MDYVLGIDLGVGSLGWALISTDSNDKKSILQLGVRCWDAKTSDDPQNIIRRQSRSRRRQNFRRAQRLRRTFRILQEMGLFPTGPWSSTARKAFLETLDQKAQEWLRTNVPDANDDGLLAHTFIYRLRAAALDHPLPPELLGRVFFHLAQRRGFLSNRKAQPKDDKEPGVVKQGISQLQDEIQKSGARTLGEFFSRLNPHEQRIRNRYTSRKMFQDEFEKIWNAQQLHHPNALTDSNKKRLYEAIFFQRPLKIPRSFVGRCSLEILTRKLANGQIEYIYPFRRAPMASLEAQRIRYMERINNLEIITPDGECRPLTPEKRKLLYDLAERNEALSFSDIKKALGIPTRKTKAGIWRLNLETGGEKRLLGNTTAAQIRKVLGDAAWEALESAKQIALVNDLIAFISADALKKHLRKKWGFTPEIAEQLAELPLESGYHSLSRRAIRRLLPLLERGERLPSAIHQIYGRNREKVGKYEKLPPVVKVFPTLRNPQVIRALTELRKVVNAVISKCGKPTCIRIELARELKLSEKERSEYTKRMRENEAQRKAAAEAVEQKLGRPAQPWEIEKYLLAEECNWLCPYTGKQITFEKLLGENPEFDVEHIWPLRRSLDDSFANKTLCYHEENRSVKAGLIPYEAYSADPVRWNQIIERVKKFKGPLAKKKLQRFLAKEIPDGFVNQQLSDTRWICKAATEYLECLYGGKADENGKQRIFTTTGGMTALLRKAWNLNSILGGAVEKNRADYRQHAIDAIVIALTEPSIIQKFSNQVAKLLRSNDARAKRGYGLLADMLDDEFREEIKQHIEKLIVQFRIKTGLSGQLHDETFYKFVAPKKAIVRKALSAMSQNDVENIVNAKVKKLVKEKLEALDIDDPKKAFALPQNLPYIRGKNNSVFPIKSALVFVNYHVVPIGREPHRRRYVRPNNNHHVEIFAAYDENGKVKGLGRVVTVLEACERRCRGEPVISKDFTCEEQQKGKFSSIEFKFALFKNSLLKCRINGEEKTVRIIAISDNLIDAKEHYDARSTKEVREQGERIRLRYAVVCGVPGNNG

SEQ ID NO: 7509 - protein, 1049 aa, unidentified
  REGION 1..1049: note = Description of Unknown:uncultivated organism sequence
MKHYDYVLGLDLGVASLGWALIEIDDNAQPISLLDAGVRCWDLNNNTAEDVTRGKEVSPNKERRDARLQRRQIYRRAKRYKKTFRILQELGLFDQGPRDSLARKAYIDKIDQQAKLWLVAHVPEAANDPWLHHNYVYRLRAAALDHPLPPELLGRVFYSLAQRRGFLSNRKGTISSDEKGVVKQAITQLEKDIQQVGARTLGEFLTKLNPHEQRIRGHYTSRSMYIAEFELIYNAQRRHYPKLLTSRARKLLYEAIFYQRPLKSQRSRVGRCELEIYLKQDADGKVTVLHPFRRAPKASLEAQRLRYMQRINDLEIISPDGEIRPLTAEERQKLYDLAEHRPELKFNDIRKALGLPAGKQSEWRFNLEAGGENKLPGNTTAARIRNILGDAWDSLGEKQKKLVDDLLAFTQDDALYKHLQKVWGFDAQTADLLVNMPLEEGFAAFSRRAIRRLLPLLEQGMRLNAAIKVAYGDHNRSTEVHDLLPPVREVFREINNPFVIRTMTQLRKIVNGVIRKHGKPARIHIELARELKEPRKKRKLEYTRQRQRQQEREEAAIQIRKALDREPKSWEIEKYLLAEECNWECPYTGRKVPGASIQERIRTLFSEPSDFDVEHILPFSRSLDNSFSNKTLCYHSENRSVKQNLTPYEAYSHDPVRWKEILSRVSKFKGPYAEDKLKKFQLEEIPEDFAQRHLSDTRYASRLAADYLGLLYGGRVDAEGQQRVFTVSGKLTALVRNAWKLNSVLGSDQKNRNDLRNHAIDAIVIALASPSLLYHYRELARVLARTSCNFVTLDPPWENFHQDVNRRIETMIATFSPNRRMSGALHEETFYSLSGENTVTVRKALKNMSIHEVEKIVDPAIRAKVKNKLKALGKNDPKIFTDEKNLPAIRVRKKGSKIKRFPIKSARIFVHQRVVPIGAGHRLRYVIPGNNHHAEVYAILDANGNELKYRVKAVSLLEAWERKRKGKPIICTNHGPGTRFKCVLRKGDYIKFVKDNRLLRVVSVSDNYIAGKDVNDGRKITDIKKNKELIVVCRKRMLWSAANERTGTP

SEQ ID NO: 7510 - protein, 1041 aa, unidentified
  REGION 1..1041: note = Description of Unknown:uncultivated organism sequence
METPTRKPFVLGLDLGARSVGWAVVDLQEGEPAGLRAAGSRCFEAGVSGSIDEGRDEARGQQRRQARQVRRQLARRQLRRTQLLRTLVANGLLPPLEVFDSLAIHRYLAAFDQGLRSRHLSADDRVGHQVLFYRLRTRALDEVLELHDFGRVLYQFGQRRGFLSGRKRRMKEGEEEGLVRKSIAALAEEMQAAGARTLGEYLAGLDPFTQRLRARWTARSMYEQEFAALWASQARFHDALTDGLRKKLAEVFFFQRPLKSQKGRVGECDLVPGRKRAPLACREAQRFRILQAVNNLRVARPGESEVELSPDERKRLLEALTAKGDLTFARVRKVLGLPKETEINLERGGEKRLVGHRTDAKMAAAFGARWEALGEPERDRIVDEVLSMEDPEALGRKAEKVWGLDPAAAAVLRETTFEPGYAAFSRKALRQLLPAMEAGEAVETARRRLFPEAVAARPAIGSLPRVEEALPALRNPAVARALTELRKVVNAIVRKWGVPEVVRIELARDLRNSRERRYRMARENRERETSREKAREEIRRSTGIAAPSRSDIEKYLLAEECGWECPYTGRRIGMTELFGEHPAFDIEHIWPLSRSLDNSFLNKTLCFHEENREHKRNRTPMEAYGNDTARFEQILARVGQFRGSARFVKLARFAADEIPSDFTERQLQDTRYATRMAMRYLGTLYGGTVDADGRRRVQAGAGGLTAIVRNELGLNSILGDGGLKSRDDHRHHAVDALAIALLDPGLVQRLQRAAERAPSHRRRHFAPLDPPWEGFLPEVQRVVDEVVVSHRTGRKISGALHKETNYSREIRTLDENGGIRWVRRLRRPVHLLTARQVEKIADHAVREAVRRKLEEVGGKADRLEEDPPVLEQPDGRRIPIRRVRVEESVNPRRVGSEGRERHVETDANHHMAIFARLDADGAEVAWEAEVVSQLEAQRRLRSGEPVIRWETEPGRSFKFSLSPGDTIELELNGVRRLLHVRSVWMEGETGRIACVNLADARQIADLRRASSWFQPRLSGLRSGGCRKVEVSPLGEVFPAGG

SEQ ID NO: 7511 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRTLALVLQEHGLLPEGELKTGSDRHAFFLQLDSELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMDNLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQLEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7512 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDSELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMDNLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGSAYNAKGRTRTFLNQIEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7513 - protein, 1051 aa, unidentified
  REGION 1..1051: note = Description of Unknown:uncultivated organism sequence
MDYVLGIDLGVGSLGWALISTDSNDKKSILQLGVRCWDAKTSDDPQNIIRRQSRSRRRQNFRRAQRLRRTFRILQEMGLFPTGPWSSTARKAFLETLDQKAQEWLRTNVPDANDDGLLAHTFIYRLRAAALDHPLPPELLGRVFFHLAQRRGFLSNRKAQPKDDKEPGVVKQGISQLQDEIQKSGARTLGEFFSRLNPHEQRIRNRYTSRKMFQDEFEKIWNAQQLHHPNALTDSNKKRLYEAIFFQRPLKIPRSFVGRCSLEILTRKLANGQIEYIYPFRRAPMASLEAQRIRYMERINNLEIITPDGECRPLTPEERKLLYDLAERNEALSFSDIKKALGIPTRKTKAGIWRLNLETGGEKRLLGNTTAAQIRKVLGDAAWEALESAKQIALVNDLIAFISADALKKHLRKKWGFTPEIAEQLAELPLESGYHSLSRRAIRRLLPLLEQGERLPSAIHQIYGRNREKVGKYEKLPPVVKVFPTLRNPQVIRALTELRKVVNAVISKCGKPTCIRIELARELKLSEKERSEYTKRMRENEAQRKAAAEAVEQKLGRPAQPWEIEKYLLAEECNWLCPYTGKQITFEKLLGENPEFDVEHIWPLRRSLDDSFANKTLCYHEENRSVKAGLIPYEAYSADPVRWNQIIERVKKFKGPLAKKKLQRFLAKEIPDGFVNQQLSDTRWICKAATEYLECLYGGKADENGKQRIFTTTGGMTALLRKAWNLNSILGGAVEKNRADYRQHAIDAIVIALTEPSIIQKFSNQVAKLLRSNDARAKRGYGLLADMLDDEFREEIKQHIEKLIVQFRIKTGLSGQLHDETFYKFVAPKKAIVRKALSAMSQNDVENIVNAKVKKLVKEKLEALDIDDPKKAFALPQNLPYIRGKNNSVFPIKSALVFVNYHVVPIGREPHRRRYVRPNNNHHVEIFAAYDENGKVKGLGRVVTVLEACERRCRGEPVISKDFTCEEQQKGKFSSIEFKFALFKNSLLKCRINGEEKTVRIIAISDNLIDAKEHYDARSTKEVREQGERIRLRYNDLLLFCGGCGVPGNNG

SEQ ID NO: 7514 - protein, 1060 aa, unidentified
  REGION 1..1060: note = Description of Unknown:uncultivated organism sequence
MDTSNNFNPYVLGLDLGSNSIGWAMIKLDENDNLCGIEKVGVRVFEAGMEGQYESGKEESRNKKRREARLVRRQIERRSRRYRKLANLLQKIGLLPDGNMNNSLERQNILDNLDKELRSKYIDANLPESEKNRLNQIFIYYLRSLAVEQELEPYALGRVLYHLGQRRGFLSNRRGQKQDDEERGKVKQGIAEIRQEMEKLGAETLGRYFAKIDPVEKRIRGRWTARDMYEQEFYAIWEHQSKYYPEILNDTNKKQVFHVIFYQRPLKSQKEKIGYCQFECIARGAQRNRRRAPWVILKAQRFRLLQKLNDLLIIENKFTKRALTEDERTLVIDYLEKNGDATFAELKKLLKLPKTIKFNLEEGGEKKIPGNRTTGAIRAVIGDLWDNMSAESKDKLVEDIYSIVSNKALKKRLINHWKFTEEQAEKLSDMGIEDGYCNLSRQAIDKFLPGLESGTPYSTLVKEIYGMDDIDTTVELLPPLESAPIGEIRNPTVTRTLSEMRKIVNELVKRYGKPKYIRIETARDLRNTKKEREKIWKNNRELEEVRAKIKKDLISKGISNPTNDDIERYMLAEECNWVCPYTGRSISFHALFEESQFDIEHIIPLSRCLDNSFKNKTLCYHEENRNRKHNRTPFEVYGTNETQWDEILRRVEKFNSRYVAEKLRRFKMHGEELDEFIDNFSSSQLNDTRYSAKEARLYCALLYGKEYRKHVFTVSGPTTAIIRRMWDLNKILGSPEKNREDHRQHAIDAIVIALTSPAMIKSISEQAEKIPKDTRKHDRWWRFITPPWNTIFNEAHEKVLNIIVSHRPERKVSGRLHEETNYSPPKPGDKNGETVVHVRKALASITKGEIEEIVDPIVRDVVKKTLEELGGDPKKAFNDPANYPLMPNKKGLHIPIRHVRVRKKLSVFPVGKNERVRYVATDENHHIEIFETKDKKGRTIWDANVVSMYTAMQRKRRGEEIIQRKLIRDGKVVEDAKFLFSLCKGDMVYMKNSDGEFEYYTVVTVSEYASGSKVMFFIQHFVAKRPKSWVGLTRYPTTLQISEAKKCSINVLGEVQIAHD

SEQ ID NO: 7515 - protein, 1038 aa, unidentified
  REGION 1..1038: note = Description of Unknown:uncultivated organism sequence
MLGIDLGTNSIGWAMIRLEDTLPVELMDMGVRIFEAGTTGDIESGKDESRAIERRAARQRRRQTDRQSRRLRTLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQLEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7516 - protein, 1038 aa, unidentified
  REGION 1..1038: note = Description of Unknown:uncultivated organism sequence
MLGIDLGTNSIGWAMIRLEDTLPVELMDMGVRIFEAGTTGDIESGKDESRAIERRAARQRRRQTDRQSRRLRTLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLNNENIRGNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQLEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7517 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDSELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQIEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7518 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQIEEPWEGFLPEVQEMADTLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7519 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDSELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGSAYNAKGRTRTFLNQIEEPWEGFLPEVQEMADTLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7520 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRTLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGSAYNAKGRTRTFLNQIEEPWEGFLPEVQEMADTLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7521 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDSELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQLEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7522 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMDNLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQLEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7523 - protein, 1038 aa, unidentified
  REGION 1..1038: note = Description of Unknown:uncultivated organism sequence
MLGIDLGTNSIGWAMIRLEDTLPVELMDMGVRIFEAGTTGDIESGKDESRAIERRAARQRRRQTDRQSRRLRTLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLNNENIRGNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQIEEPWEGFLPEVQEMADTLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7524 - protein, 1041 aa, unidentified
  REGION 1..1041: note = Description of Unknown:uncultivated organism sequence
METPTRRPFVLGLDLGARSVGWAVVDLQEGEPTGLRAAGSRCFEAGVSGSIDEGRDEARGQQRRQARQVRRQLARRQLRRTQLLRTLVANGLLPPLEGFDSLAIHRYLAAFDQGLRSRHLSADDRVGHQVLFYRLRTRALDEVLELHDFGRVLYQFGQRRGFLSGRKRRMKEGEEEGLVRKSIAALAEEMQAAGARTLGEYLAGLDPFTQRLRARWTARSMYEQEFAALWASQARFHDALTDGLRKKLAEVFFFQRPLKSQKGRVGECDLVPGRKRAPLACREAQRFRILQAVNNLRVARPGESEVELSPDERKRLLEALTAKGDLTFARVRKVLGLPKETEINLERGGEKRLVGHRTDAKMAAAFGARWEALGEPERDRIVDEVLSMEDPEALGRKAEKVWGLDPAAAAVLRETTFEPGYAAFSRKALRQLLPAMEAGEAVETARRRLFPEAVAARPAIGSLPRVEEALPALRNPAVARALTELRKVVNAIVRKWGVPEVVRIELARDLRNSRERRYRMARENRERETSREKAREEIRRSTGIAAPSRSDIEKYLLAEECGWECPYTGRRIGMTELFGEHPAFDIEHIWPLSRSLDNSFLNKTLCFHEENREHKRNRTPMEAYGNDTARFEQILARVGQFRGSARFVKLARFAADEIPSDFTERQLQDTRYATRMAMRYLGTLYGGTVDADGRRRVQAGAGGLTAIVRNELGLNSILGDGGLKSRDDHRHHAVDALAIALLDPGLVQRLQRAAERAPSHRRRHFAPLDPPWEGFLPEVQRVVDEVVVSHRTGRKISGALHKETNYSREIRTLDENGGIRWVRRLRRPVHLLTARQVEKIADHAVREAVRRKLEEVGGKADRLEEDPPVLEQPDGRRIPIRRVRVEESVNPRRVGSEGRERHVETDANHHMAIFARLDADGAEVAWEAEVVSQLEAQRRLRSGEPVIRWETEPGRSFKFSLSPGDTIELELNGVRRLLHVRSVWMEGETGRIACVNLADARQIADLRKASSWFRPMLSGLRSGGCRKVEVSPLGEVFPAGG

SEQ ID NO: 7525 - protein, 1036 aa, unidentified
  REGION 1..1036: note = Description of Unknown:uncultivated organism sequence
MGGSAERTVLGLDLGANSVGWALVGYENGEPAQIVDMGVRIFEAGTDGDIASGRDESRAVERRGARLRRRQTKRQSERMTELARTLQRFGLLPPGELRKGADRHAFFLALDDRLRADFAAQGFSVDQSDGLREFPYFLRARALDAPLEPHALGRALYHLAVRRGFQSNRKSDKEEKELGVVKASISVLEQAMRESGARTLGEYFHRMDPSLERIRKRWTARSMYKDEFDQILDAQARMGALALSPDDRKTLEYRIFYQRPLKSQKGLVGRCELEPGKRRAPVALLSAQRFRILQKVNDLRLHYLDGTERGLTEEEKKTLAAFMEIHDEVSFAGMRKALKLSKEVDFNLERGGEKKLKGNVTNARLLKVFGDRWNTLGDTEKKAIVGEILGIEDFMALARRGLAWGLGPAEAEAFAKIHLEQGYSALSREALKKLLPLMEEGVPFKTAEDRVYGNRLLGKEARPKLDPVVVALPSIRNPVVMRTLTEMRKVVNAVIAKHGKPDEIHLELARDLKKTREARARHSRDIRGREQDRTDARESIQKKLGQQKISRQDIEKVLLAEECGWICPYTGHSIGMSTLLGEHPQFDIEHIIPFSRCLDDSFMNKTLCYHEENRLRKGNNTPWEAYGGDEKRWEEIIARVERFKGDAARRKLERFQSRDIADFEGFAAQQLNDTRYASKLAARYLGMLYGQDALKHVQTSAGQVTALLRDALHLNGLLGGGDKKTRDDHRHHAVDALVIALTSRAAVKRLSDAAKRQKLEKGRIQGFLKNALLPWDSFPADAQSAVDGILISHRVNHRLQGRLHEDTFYSAPRKDENGKPYHVVRKPLDVNFKPADVQGIEDPAVREAVRAHLAAHGNDPKKAFADPANHPRLPGANGPVPIHRVRIRRACTTFQIGGNDYARFVTADSNHHMEIVEETRNGKTRWTGVMVDRLQAVSRKKRGEDVVQKDHGEGKKLVCTLAPKDTFYLKEENLYGIVRSVSNGNVEFISIFDSRKVLDLKKDSGVWRKRSVDALRDLGFVKVTVSPIGEATPCHD

SEQ ID NO: 7526 - protein, 1041 aa, unidentified
  REGION 1..1041: note = Description of Unknown:uncultivated organism sequence
METPTRKPFVLGLDLGARSVGWAVVDLQEGEPAGLRAAGSRCFEAGVSGSIDEGRDEARGQQRRQARQVRRQLARRQLRRTQLLRTLVANGLLPPLEVFDSLAIHRYLAAFDQGLRSRHLSADDRVGHQVLFYRLRTRALDEVLELHDFGRVLYQFGQRRGFLSGRKRRMKEGEEEGLVRKSIAALAEEMQAAGARTLGEYLAGLDPFTQRLRARWTARSMYEQEFAALWASQARFHDALTDGLRKKLAEVFFFQRPLKSQKGRVGECDLVPGRKRAPLACREAQRFRILQAVNNLRVARPGESEVELSPDERKRLLEALTAKGDLTFARVRKVLGLPKETEINLERGGEKRLVGHRTDAKMAAAFGARWEALGEPERDRIVDEVLSMEDPEALGRKAEKVWGLDPAAAAVLRETTFEPGYAAFSRKALRQLLPAMEAGEAVETARRRLFPEAVAARPAIGSLPRVEEALPALRNPAVARALTELRKVVNAIVRKWGVPEVVRIELARDLRNSRERRYRMARENRERETSREKAREEIRRSTGIAAPSRSDIEKYLLAEECGWECPYTGRRIGMTELFGEHPAFDIEHIWPLSRSLDNSFLNKTLCFHEENREHKRNRTPMEAYGNDTARFEQILARVGQFRGSARFVKLARFAADEILSDFTERQLQDTRYATRMAMRYLGTLYGGTVDADGRRRVQAGAGGLTAIVRNELGLNSILGDGGLKSRDDHRHHAVDALAIALLDPGLVQRLQRAAERAPSHRRRHFAPLDPPWEGFLPEVQRVVDEVVVSHRTGRKISGALHKETNYSREIRTLDENGGIRWVRRLRRPVHLLTARQVEKIADHAVREAVRRKLEEVGGKADRLEEDPPVLEQPDGRRIPIRRVRVEESVNPRRVGSEGRERHVETDANHHMAIFARLDADGAEVAWEAEVVSQLEAQRRLRSGEPVIRWETEPGRSFKFSLSPGDTIELELNGVRRLLHVRSVWMEGETGRIACVNLADARQIADLRRASSWFQPRLSGLRSGGCRKVEVSPLGEVFPAGG

SEQ ID NO: 7527 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDSELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLNNENIRGNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQIEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7528 - protein, 1046 aa, unidentified
  REGION 1..1046: note = Description of Unknown:uncultivated organism sequence
MTNQHAPYVLGIDLGTNSIGWAMIRFDDTRPVELVDMGVRIFEAGTTGDIESGKDESRAIERRAARQRRRQTDRQSRRLRSLALVLQEHGLLPEGELKTGSDRHAFFLQLDGELRNHYAEQGIALNCAAGLREFPYYLRAKALDEKMPLHATGRALYHLAQRRGFLSNRKTDSNDKETGPVKEGISDLAQKIKQANMRTLGEYLFNIDPVHEKRIRGRWTARSMYEEEFNLIWEAQSRWHPQLYNENIRWNIHKAIFYQRPLKSQAGTVGYCDLEPFKKRAPKALVVSQQFRILQKINDLTVHFADGDVRPLNNDERVSLFEYMNERESVTFKQIRKRLSLPPDTEFNLERGGEKKLPGNVTEARLLKIFGKNWHSFNDAFHHEIISLIMGSEKAESVRKLGKNKYGLDDDQAEKFSRLQFENGYMSLSKKAMTKLLPLMKEGVSFKTAEKKLYDNPRNLCLDFLPPLHTHKNDRFSPQPDAGLDIRNPVVTRSLTELRRVVNNIIAKYGKPLRIHVELARDIKRNREQRKLISTENRDRQRSRESIVAQIKEKLGEHYMPSEQDIEKVLLMRECRCICPYTGRTINMENLLGDHPQFDIEHIIPFSRSLSNSFANKTLCYHEENRNRKRNKTPWEAYGNTDQWDQIVTRVKSFCGPTARIKLERFQLRDLSSLDEMSSQQLNDTRYASKIAARYLGLLYGENAMRHIQTSTGQITAYLRAGWHLNRILSTQGIKNRDDHRHHALDAIVIALTSRSAIQTLSKAAGNAYNAKGRTRTFLNQLEEPWEGFLPEVQEMADNLFISRRINRRVRGRLHEDTNYGYPRTDENGKQWHPIRKVLTETFKDTDIDNIIDPVVQDCVRTHFEANGSNPQKAFADPDNHPRMHDGTVIHKVRCKRTVSTTPIGSGDGTRFVATDTNHHMEIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 7529 - protein, 1033 aa, unidentified
  REGION 1..1033: note = Description of Unknown:uncultivated organism sequence
MAKKHEETVLGLDLGTGSVGWGLIEFDGEGPRRIIDAGVRIFDAGLDSLKVDGRGKSRNLERREARQIRRGLERRGRRMRNLARLLQRSGLLPKGNVTDSNDRHEFLKEFDATHDDPYSLRARAINERLELHELGRALYHLAQRRGFLSNRKSAPKKDEDAGQVKAAIKDLQSEVEDENAATLGVLFNRRLIRGERVRGQYTGRQMYLDEFDLIWASQARFHSDVLTESLRKHVHHTIFYQRRLKSQARFIGKCELEKGRQRAPMALLICQRFRYLQSLNNLRIIDTSTGELVEMDQKQRETVINALEYGGDLKFSSLRTTLGLKRTAKFNLERDGEKRLIGNRTSQKLATVFGEDRWRMMSDHQREQVVEDWYCIVKEETLKRRGVRYWELEEEAAEQLAHLRLDSDYSAYSRQALARIVPLLERGMPLQSAIKEVYPEHFDRTGKPLSQLPEVKCKQLPDLRNPVVTRTLSEMRRVVNAIINRYGRPDVIRIELARELRQSSRQRQATTKRIRENQSKREAAAQAILEEAKIPNPSRRDIEKYLLAEECNWTCPYTGKRIGMDSLFGAQPQFDIEHIIPFSRSLDNSFVNKTISDVHENRRVKGNRTPHEAYAETSGWPQILERVRQFRGRLASAKLRRFKMDRKQLDSHIAEFSNRHLNDTRWAARSAKRYLGLLYGGVNDDGIDASRRRRVHAVCGPVTAYIRQTHGLNTVLGTGDTKSRDDHRHHAVDALIVALTGPGVIKKLSDAAARAAVDSGRLFKDMPLPWATFHTDVEAVVNSIVPSHRISRRVRGALHKDTFYGVPRTGKDGHTFVTARKALQNLTPAEVDKILDPTIRDLVAETLSRLGKPPNQAFADENNLPVIRSQDGSETRVRRVRIRARLTSPQNVDSTHAPRYVDFGNNHHMAMYETTDDDGSIKWEAEVVSLYEAYRRKRSKEPVVHQESTERRRFLFSLSGGEIIELTRNGVANLFVVRSIEATGNIRFAPVKDARTLKEIGKKGLTALPEPLRKQGCLKLVVTPLGEVRTDNS

SEQ ID NO: 7530 - protein, 1033 aa, unidentified
  REGION 1..1033: note = Description of Unknown:uncultivated organism sequence
MAKKHEETVLGLDLGTGSVGWGLIEFDGEGPRRIIDAGVRIFDAGLDSLKVDGRGKSRNLERREARQIRRGLERRGRRMRNLARLLQRSGLLPKGNVTDSNDRHEFLKEFDATHDDPYSLRARAINERLELHELGRALYHLAQRRGFLSNRKSAPKKDEDAGQVKAAIKDLQSEVEDENAATLGVLFNRRLIRGERVRGQYTGRQMYLDEFDLIWASQARFHSDVLTESLRKHVHHTIFYQRRLKSQARFIGKCELEKGRQRAPMALLICQRFRYLQSLNNLRIIDTSTGELVEMDQKQRETVINALEYGGDLKFSSLRTTLGLKRTAKFNLERDGEKRLIGNRTSQKLATVFGEDRWRMMSDHQREQVVEDWYCIVKEETLKRRGVRYWELEEEAAEQLAHLRLDSDYSAYSRQALARIVPLLERGMPLQSAIKEVYPEHFDRTGKPLSQLPEVKCKQLPDLRNPVVTRTLSEMRRVVNAIINRYGRPDVIRIELARELRQSSRQRQATTKRIRENQSKREAAAQAILEEAKIPNPSRRDIEKYLLAEECNWTCPYTGKRIGMDSLFGAQPQFDIEHIIPFSRSLDNSFVNKTISDVHENRRVKGNRTPHEAYAETSGWPQILERVRQFRGRLASAKLRRFKMDRKQLDSHIAEFSNRHLNDTRWAARSAKRYLGLLYGGVNDDGIDASRRRRVHAVCGPVTAYIRQTHGLNTVLGTGDTKSRDDHRHHAVDALIVALTGPGVIKKLSDAAARAAVDSGRLFKDMPLPWATFHTDVEAVVNSIVPSHRISRRVRGALHKDTFYGVPRTGKDGHTFVTARKALQNLTPAEVDKILDPTIRDLVAETLSRLGKPPNQAFADENNLPVIRSQDGSETRVRRVRIRARLTSPQNVDSTHAPRYVDFGNNHHMAMYETTDDDGSIKWEAEVVSLYEAYRRKRSKEPVVHQESTERRRFLFSLSGGEIIELTRNGVANLFVVRSIEATGNIRFAPVKDARTLKEIGKKGLTALPEPLRKQGCRKMVVTPLGEVRTDNS

SEQ ID NO: 7531 - protein, 1043 aa, unidentified
  REGION 1..1043: note = Description of Unknown:uncultivated organism sequence
MRQTSLNKTVLGLDLGSNSLGWALLEFEGNKPKAIIDCGVRIFKAGLEGDIESGNAVSRARERREKRSLRRQTDRKKRRRGHLFHLLQELHLLPEGTQGEVFPSLDKSFIEKYSHAEGLPKKILASKLPYWLRARALEHSLEPYELGRVIYHLGKRRGFLSNRKTPAKQEEGIVAKEISELRDEMKTVGARTLGEYLAGLDPQEERIRSRYTQRGMFQEEFEAICTFQKKFHHGLNEDNIARIGKTIFFQRPLKSAKKLVGHCELEPNSRRAPWATLEAQQFRYLQMVNNCSIKTKDDLSFRPFTDPERTILIDHLEQDGDLTFAKAKKLMGKESKTTAFSFEAGEESRFLGNRINKALKGIFGNDWFAFDKEKKESILADLRSYRDAQALAKRAQEVWGLDSQKAQEFASIELEPGYCALSRKAIKKLLPYLEQGVPYASARIEVYGALLKPRLAEAFLLPVKQLFEIRNPVVERSLTELRKVVNSVIRKHGKPDRVKIELAREMKQSQKKRKEITRTNRLNEKRRQEAAQKITKEVGIKNPSRNDILKVMLGEECNWICPYTSKSISMMSLFGDSPQFDIEHIVPFSRSFDDSFANKTLCHVDENRAFKRNRSPWEAYHGSPKWEDMLDNVKRFKGDLRDSKLERFLKRPEELEDLDGFISRQMNDTRYASKLAMHYLGTLYGGLYDKEKHQRVFAVTGRVTSILRNAWSMNSILNDGGVKERGDHRHHAVDAVAIALTSPTTIRGLSEAALPSYERNAYRKRFKPFQMPWPTFFQDLENRISGILVSHRVNHRVNAALHEETNYGIVKASKEKCFCIRRKLDSLRASEIDQIIDKRIAQIIRDKLSELKQTDPSKAFVSTENHPYFVSAKGETIWIHKVRIYVSTNANKLGDGLTERYVTPRSNHHMEIFEVTDLQDPCNKRWECEVVDTLGAMDRLRKGQPVVRKEAEGKRFLFSIATGDTLKLHNPGEWPEYLHVRKVSKTLDGRMEIAGVSINDARLKKDIVNTKEFYRIASVIKLQNLDPQKVTVLPCGEVLVAKG

SEQ ID NO: 7532 - protein, 982 aa, unidentified
  REGION 1..982: note = Description of Unknown:uncultivated organism sequence
MDDDIEQGKGVSRCAERRLKRALRIQYRRRRKRKDDLISVLQENGLLPDPLTPAFFTSVDEKFLRPLSKTDRKTLGHVIPYLLRKKALDQPLSRDELGRAIYHLAQRRGYLSNRKQDLKNEEESGAVKAGIDQLKKEMSAAGARTLGEYFCQVNPEEARIRTRYTDRAMYQEEFRKICQAQRALISEELEKQLFNVIFYQRKLKSCKNLIGACSVYPEEKRCSYACEEAQLFRIYTNLNHLRVEKAQQIRSLTEEEHDRVLAVLNGFSDLLTRKGTITLKNLAKAVNLPKGAKFTLSDEEKEIYGNVLHAALFQVFGPRAEKLPPDEREKFFNDLKSIEKPEVLKHRLTGYWQLSAEKAELAEKIALPDDYCAFSLKALKEILTELEAGIPLSTIRKVIFPQQPGVALDSLPILDSDETALDLRNPVVHRVLTELRFVINTIIARYGKPDRIRIELARDLKSTNKERERRTFEMRKREKERAAIAAKITQEAGIEKPSRNDILKVMLAEECGYECPYTGRHFSMKDLLHGKDIHIEHIIPYSRSFDDSFRNKTLCLAAANAAKNNHTPFEAFSGTEYQNILQRVAHFNGPYAEAKLALFKLEKVDPQEFLERNLNDTRYASRLAMQYLGMLYGGTTDKAGKQRIFATSGGCTAMIRRAWGGNYLLGEGEKVRDDHRHHAIDALTIALTTPERVKMIAGMMPEYRKKLQDCKPLIDNDAYSQALAMLDQSAVSHHVVNKIRGAFHKETIYGKNYGNDIRHKRVKLNELTVKDIPDIVDPAVKALVLQRTGCNEDQLGVLTDKDLQKLLDVSNPLVFKDKNGAPVNVIKAVRVKQRVSARTIGSGDSVREVANGSNYLLAIFAKLDADGNETGWEGEIVTLMDARYRLLHHQPLFERNRPGMKFKFTLKKGDIVTFVKDGVERLCIIRGVSLPTFYCCPVRDARMQRELKAAKVWFWPTPSAAFQWKMTKYTMNLFGELRRAND

SEQ ID NO: 7533 - protein, 877 aa, unidentified
  REGION 1..877: note = Description of Unknown:uncultivated organism sequence
MTLPADAPPYVLGLDLGSASLGWALIALDQHNNPAGLIRAGVRIFQPGVEGSTLDIERGKDQSRAVMRREARLHRRQLRRRAARQRDLFRLLQQHGLLPRGSDGGAASSEQRHSVLNELDKALTKCLSAGAANDPVAATRINQSFPYQLRKAALDRKLEPQELGRVLYHLIQRRGFKSNRREGKKGKEKQDELGKVKAGISELEQKMVSSAARTLGEYFAGLDPHQQKVRRIWTARRMFEDEFEKIWTVQQAYTPEFLTAELKAEIARLLFYQRPIASQEHLIGRCELEPDQPRAPWATLEAQQFRVLQKVNDLKVVVPGSLDDQPLTPEDREKVYRILQSEGDKTFAALRKLLRLPRSQFNLERGGEKTLRGNRTNDLMRSVFAARWDEFSPDQRHKAVEPWRTTEERDTLVKIAVEAWGLDQLAATRWADKDPEDGYCGLSLKAIRKLLPRMEAGVPFKTAEKEVYGERFSGQEPKDYLPTVREALPTLRNPAVERAVTEMRKVVNAMVREYGKPYEIRLEMARELRKSRKEREDITKKNRGREREREQAKARILRECGIQNPSREDIEKALLFEECVGICPYTGRTIEFSALFGESQFDVEHIIPRSRYPGGSFLDKTLCYHEENRSIKGGHTPWEAYGADEERWAAILERVKKFNNPAKLTRFKLRTQDELEEFTQRQMNDTRYTTRLAADLLGTLYGGRDETLADGAKRRAIFASSGQVTATLRRVWGLESILQQALASSNGENRGKPRTDHRHHAIDAIVVALTSERTVKLLSTVAAQAPEWQLDRRVFRRIESPWPNFVDSIRPHIEQMIVSHRPEHKMSGALHKETIYGPPHLFEEKSVVHLRRLLPGIPAGQIEDIVDPIFTDERGHD

SEQ ID NO: 7534 - protein, 1024 aa, unidentified
  REGION 1..1024: note = Description of Unknown:uncultivated organism sequence
MKRILGLDLGVASIGWSLLEQDEAQGKILKSGSRIFQSNEQRADSAPGESAKSDRGTKRSVRRQRDRRTRRKQKLYNLLFKNGMAPRKEDWNKWIILNPYELRTFSLDKELKPDEFGRALYHLNQHRGYKSNRKDGEDKDGVVSKGILKIQQLMEQYQARTFGEYCFKILENHRIYEKTPLDDDWRIRDNYTQREMFKKEFEQMWSAQQRFNAPLYTDSLKAEIFECLFFQRKMKSQAHLIGKCPLEKNKRRIAKAHLLFQEFRILKNVNNLALADENGIPITLSLEDKRSLFDVMNKRDKVTFKSLKTTLVNKGVIANTNVVFNLEVGGRKDIEGNRTNKKLSNEKAFGEAWYDMDSELKDYIVYVLVHFDDPYKVKEKALNEWNRTDEQASYLSYLTLEKNYAGFSEKAIKKLIPFLKEGMEESAAIKAAGYEIFSQKQGNHTRLPMPPDIKNAVVYHALIELRKVINGIIRVYGMPDIIRVELTRDIKAGYERRQKMTKNMRDLEKRNVKAKKALQHAPFNRQEPTFNDLLWYNLWEECERICPYTEKQIPAEAFNTGEFQVEHIIPFSRSLDDSFANKTLCDADFNRRKGNRTPWECMQAGLITEDELIQRTRQLPWNKKRKFVQKATDENSFINRQLSDTRYISREASSYLKQLACEQVEVVKGQSTSLLRHVWGLNGVLNTENEEMKTRDDHRHHAVDAIVVALTSRSILKRLSDENTKLSSEEWKSIEESGKEQYEELKKRIDGRIWLSEPWPYFRYTVEQSINDITVSHRINRKISGALHEETFYGPTNVSAPRKKVMMVVRKPVHALSKKDVGLIRDKGIQQIVNRHIQAIIDEGQTFENAIKSLETNPPYIVSDKAKVPIRKVRLLMEKEPSIMHAFTNGENKVFKHALYGNNHHIAIYSTIDKKGAPKQVGFVVPMIEVARRVKDGEPMVDRTYLPNHTFLYSLSKNEMIINHEDEEIYRVQKLASNGQIVFRRTSVALKGQNDPGVLRKNPGTLKATKIKISPIGEVFPASD

SEQ ID NO: 7535 - protein, 1128 aa, unidentified
  REGION 1..1128: note = Description of Unknown:uncultivated organism sequence
MPDGAPLDYVLGIDLGSNSLGWAMIRLVDGEPAGLIRAGVRVFEAGMEGDLESGQEESRNLKRRQMRLQRRQTWRRGRRLRKIFNLLQRFGLLPPGDASTAEKRQDLINELDKTIRASDWFKTKVACGKFPEPEQTLPYILRASALDERLEPHFFGRALYHLAQRRGFLSNRLRPAKAGEEDEGKVKGTIKALRGQMQQRGCSTLGQLLSQLSPTEKRIRGPEAWTARDMYESEFDLICEAQASHPPEALNEEHTAKLRDAVFHQRPLRFDPNVIGKCELEPDERRAPAYLLPAQRFRLLQTVNNLRLLPPGEIEKPLTPADRQKLTAALDVKRELKFSEIRKLLGLPRDYVFKGEAEGEKRVIGNRTSASFYEVLGERWLTMSSAERDRLIEIVHSLPRAEDLIPVLRADWGFDDDAAERLSDISLEPDYANLSRKAMERLLPRLEQGESFMEARKGEYPESFKASLPLPSLPPLASEEVERRVGTVRNPTVTRCLSELRRVINAIVRSYGKPTQVRIELARQIKKPKKQRQAISKRNQENEAARDRAKVRIKEITGDEHPSRDDIRRVQLSDDSCKQCVYCGESIAARNFLGRESQVDVDHIIPFSRSLDDSYMNLVICHSGCNRAKGDHTPHEAFSGNAELYSQILDRVKRLAGDRRTVAEKLRRFRMNQEELSSFLDDFRNRQLNDTAYAAKLATRYVSLLYGGIADAAHEQRVFAPSGQTTSYFRSLWKLNSVLNDGPTKDGGLVPKSRDDHRHHAVDAVVIGLTDPGMVKRLSDAAERAPSAGRRRFASLEGPWPNFTDSVRAEIEKIVVSHRVSKKVSGALHEETIYSRPMNATAASPSVGPTLGSAGVAPGFSPAGADPSPLSGQALKVGATVAAISDRRRRPKKNGGGDTAATIVHVRKSLANITRQEIKDIVEPSVRKLVQAKLGSLGNGDPKRLFSVEANLPCFETKDGRRIPIKRVRVSKAVPVFPIGGGRSVRHVASDSNHHVEIYARLDDRGNEVEWGGDVVTMYEAFQRVKAHRPIVEQDHGSLVNFKFSLAPGEVIECDGKGDGRGLFVMRKASQLSAGQLSIGFAPLRDARKAREIQESKAWLWANPDTLRQRNPRKVVISPLGEVNEAHD

SEQ ID NO: 7536 - protein, 1014 aa, unidentified
  REGION 1..1014: note = Description of Unknown:uncultivated organism sequence
MAYTLGLDLGSNSIGWALVDEDAHKILRSGVRVFPEGVDRNKQGGEISKNENRRIKRGMRRQILRRAARKKALRKALMGVGLLPSDPAEAAALDHLDPYSLRIKGLDEKLNLFELGRVLIHLNQRRGFKSNRKGARTTEEKGMLAEISELARNIEHSGCRTLGEYLHGQQRASGATVRVRGKHTRREMLRDEFDLLWSKQRAFYPEILTEELRAKLWDGLIAYQRAMYWPKSAVGQCELEPKEKRCRRDHRVAQRFRLLQDVNNLRVISATGELRGLSVEERRKLIAYLSTAKECTFDEIRKHLGLLDSHGFNLEFGDRKKLLGLSTDVLLSGKKLFGKRWHEMPEQIKNQIINALLDDEIPEEKLVQTAQEQWEADSDLARRLAEVDLKPGYASYSLKAMLKLIPFLEQGLPLSGRTGEPDALHLAGYLRPDEQAINQQRFLPQPPDLTNPLVRHALHQVRQLVNAIIREYGKPGAINIELARDVKGTALQREKQSREMRQRERKRAEVAANIEKEIQIQPKPRDIERYILWEQQGKVCMYSGQSISVAQLFGGDVDVDHILPYSRSLDNSKLNKVVAFRTENSAKSNQTPYEWLAKSDPQKYEQVLQRAARLPLEVRNAKRPKFAVKSLQLEEFVERQLNDTKYITRKVAEYVRCLAVDVVCTKGQCTSELRRYWGLETVLRDDGLALKNREDHRHHAVDALVIALTNRSRLQALARVRGRDEFPRPWENFRDAVEQSVNSIKVSHRVQRRVSGALHEETLYGPTAKPWKGGEETRRDVDGVVKERPWATGWAEENGAFVYRKPLEALTAAMVPAIRDPAVRKIVEERLKNHGIESASTKSIPVAVWKVPLRMPGTNGPVIKRVKLIRRDKTIIPIRSGRACVKTGSNHHVCIFEFDERGRKKREAVWVSMIEAARRVREREPLIQREHPMRKDATFLMSLAPGEMVLGTFKGHERLCVFQTGASTQGQLYFAEHTDARKSGDREKFAVTASTLAARKVTVDPLGRIRWAND

SEQ ID NO: 7537 - protein, 1083 aa, unidentified
  REGION 1..1083: note = Description of Unknown:uncultivated organism sequence
MKRVLGLDLGTNSIGWAVLDVPEHENPEEDTGTVVAMGSRIFTQGAEEAGAALETPAKERRAKRSMRRQIQRRAKRRQRIRHELQGIGLLPGDDQEFDELMTSDPAALMASSVEGANLSLREIGRVIYWFSSQRGFLSLRAGGGDTTDEDDDRATRNRYRNPQTVKETGEIKVRGQENILVDFLYQQAKHHPALLTDEIIFGARGRLTYPVRPIKQGNFLSGGDSWLGEFGIHGLVFFQRSVYWDQKTIGTCSLDPRKGGPRVLRADRNAQKYRVWKNILDLRVETPQRSLSDGERQVVYDTLMTQGSVSFNSLRKKLKLPDDAAINLALSEREELKGNETDAAMRKALGDAWEEMDEETRDNIVSVLLGNALEDQVRSVLQKEFGLDDEAANAAIEVRFPSGRSMFGRHTIKQLLRFMPEGPMASSEALQETLGGVWEALSDTQQENLISLLLDDTKRSKEKKALSATLASDFGLTSAQIKAVVGVRANESKDIKEERGALIKNERHVIQAAGFRMPEEVRSERPVDIEKLTNPLVRQTLSQLRKVLHAVAHSHGLEGDQPFDIVRIELTRDVRSNYRARKETNQRQRQNEKDNQAAEKMIEEFAAGGKISYDHRRRARLWKEQGEQCLYCGQPISSIEAFTSATELDHILPRSRTLDNSMANLALVHADENQDKGNRTLTEWLGPEGAFEIAQRARKHIPYPHWKPKMRRIEAIDVADAPVPEALLVQTGYINSVARDFIRQELGIKAEVSSGRITASLLYHTGLKKDSEDHRRHAQDAAIVAVCDKRTSLRLSKLYQRKQATGSYSDESEHGGWEPWEGYREAVKDCYADINVSHAIKGKVSGQWHEETYYGKVESPYLEGDDVYAFRRPVSWVTSPKKLAEVADPAVQEALRQNLRDRGLDPEGSSFKFDEKTPPHMPKDKNGDANVINTVRLHVNKPGNKILRPETEPKTGVVMGRNHSAFLYENTETGKWRLHIVTRFDAFLNRGKNLEDARAEYAGEGEEFLFSVTIGAAMMLEVDGEEELHFVRSIALSVKSLDLRPAATTSSGKLVWYGGSKLKNLKAHKVVVLPNGAVRTARD

SEQ ID NO: 7538 - protein, 1094 aa, unidentified
  REGION 1..1094: note = Description of Unknown:uncultivated organism sequence
MDDYILGLDLGPNSIGWALVRAERQGDGFAPAGLLNTGLAGHPPLGVRVFEAGLQNFNTGKEASKNQARRQARATRRTISRRRERKRAALAALVGADLLPPDTCDLEAVMAIDPYEARAAALDRALRPFELGRALYHLAQRRGFKSNRLSESDSDEKGMLLEISRLEKEIQSSGARTLGEFLHTQRKTKVGGIPARIRARQARMDLYADAPRRTRRSMYEFEFAAILEAQREFGGRELLTAEARLELHRALFFQHPFAITEERIQRAPSRANLHRAPGVRACPYEKDQFGCPRSDWLAQRFRILKEVQSLRLSEQHRRERALTPEEVMFTIQILSGTKEKGFAQLARDLTKEFQLTEPVTFNLARGGRGGLKGNAIDAALAKGFGKRVWRDLDESACEALRTGIVELTTPSELDELLQRHGLDDSARRRELCNFRSPDDGYLSFSKRALLKLIPLMEAGRPEHEAIAQVYPETFEADGLASLPSLVGMQLDPKTRAKIPPQIQNELTNLTNPIVRRALVEVRKVVNAIVRTHGRPARVVVEMAREMKQGKTARKEQGAQMNARAKRREDARAKLRSLRGGGEWPSRDDVNRWMLWEEQCHCCPYCGKGIAMHEVANADVEVDHILPRWRSMDDSMNNKVLCCSVCNADKGNRTPAEWKGKDSPELALLLKRAWACVAKKDNPGGMPFGKIKRFEVEDLEPDKFASSQLNDTRYISRLVGNYMRLLYPTEEHSGQSCVQSSKGNLTAHLRRMWGLNGVIPPLVQAHGEVVSGIVPHEGWNEKVRVDHRHHAVDALVVALSSAAFVKRLQDCWRRDEDPTDQGASFEAPWASLRADTIEAVQQIRVSHRPMRRKRGALHEETYYGAVDTEAGRYVTRKALNNLTPSTLKDIRDPKVRAVIEERLRACGWQGGTSVLPKGWFQEELFLPVANPKPGRRSRSPHPIRRVRIEKTIGRSVRLGDKGHRHAVPGGNFCLQVFHSDTEKSPQFRVLSRFEASQRGTGLAAPTGFTLAATLHRKDSVLVEVDGLEEPVHAVIQMISGPSEIGTAGLDVTLRDARDSRKAGDARGSELMRIKSAARWKACRIRPLGIDPMGLV

SEQ ID NO: 7539 - protein, 1191 aa, unidentified
  REGION 1..1191: note = Description of Unknown:uncultivated organism sequence
MKLLGLDIGSNSVGSAWIDTNKQIIEMGVSVFPAGVEEQQDKRGAPKNQARRSQRQQRRSIERRARLKRRLRQYLIQKNWIPTEKTKLKEWKNLNPWILRKDALHRELNELEFGRILLHLAQRRGAWWFDEEPEEAEKSKKEKKDPTETPGTVEYTKKIMEAKKAKTFGELIATEYEKRKTPTGNKDKKRNDRVRNRNDAFGDKVSEFVADRHMILAEFLKIWETQKSFGGQLAKQLTKDCKKEIYNPKKTQTWRCQGVLFSQRKAYWDLGTLGRCDLEPTDMKCSKADMYAQEFLVLTSVNNIRITPPMAAGRKLDDIERSKVINAVRKQKTTTESTIRKALGIDKGKNKTLYTLNTEGDKFTVNGDWFYSQIVCGVFGEDKWLSFDNGKKESVNRAILKFDPNEEADEGKIRTGCGNWWNLDSEQTENFIAAWKKRPKKESRVNLSRKAIKNLLPYLREGWSVTEARDMYAEDASNGADDLTRRRYSTKEIVVNKRIRHFQDKHPNLLPPVTEGISNPVVRKSIHEVKKHLMEYIRQFGKLPDRVVVELAREARQTEKVISKRIQKNKAIDALKKEIIETHNLNAPSITSTQRERAIQRVRLCRQQRQMCAYSGVTITDKTAADGGGLEIDHIVPRSKGGGNGMNNLVLCYATANQGKGSRTPIDWLSKENFGQLELRFKHLKRDKKDKSAITKDNVDMTDNAKWENLHRKTPKEGFTEEQLSSAAYAATQTTDWINKILYGSEDRTKRYVFASNGNYTGILRRDWGLFFDDEGERSEKGRKMRGDHRHHAVDATIIAMTLQCLPKIKQSFVDFEKQKENKNITPHWETIEQPWEGFSEQIADVYKNLKVSHRAYNKQISGYLHKDTIYGPALVYEKAEKGDVKIDKDGKPRIKKGLYVKSIPAIGIKHNHLRMPNGWDRLKEEYKKANTKSERRVIRKKMLTLEDAPPAKSGIIRDIELRDKIRDWLKEHHFEDMGKAKEYIKENGLIINGTPVRKVRVLWKLKEVVEIPRKCFNFESGKIVMDDNYKSLRVYQTQNNHHIEIRVKANKNGEIKWSGEVITNFDAARRVRAGKKPIVDRNENKNGKFVMSLARGEMVYMKHPETQKPNYFVVFKIDSSKAIHFTPHTDANPASSKKKDVKLREDIRLPGKKTGGLTVSQLQGLGVERGKWPEKVHIGPLGDVKVLVRD

SEQ ID NO: 7540 - protein, 611 aa, unidentified
  REGION 1..611: note = Description of Unknown:uncultivated organism sequence
MAPLPLNQQRAAIDRVTLCREQKGICPYSDLTPGAEGKVIGEKQAAEGRDVEIDHIVPLSRSQDNSLNNKVLCCRQANRGKENRTPKEWLTAEQFELLEQRMAHWKKDCPRKWENLHREPLPEQDFLNSQLAATAYAARQVGAYLSDSLYGGERDGRRRVFFTKGTYTAMLRKDWQLFQTLREADESLAADGTSGPQERTDPGKKNRADHRHHAIDAAIIALTGPEIIKDVARLAAEREEYHERTGYWPRRVSLPPPWGNVDDFRRQVLSQLFGVFDKANTDWTRAEGAETGTPLVVSHRPVKSRLVGPLHEETAFGPVRGSKTLFTNRIRAEKLTPNHLRVPDGWNVLSDKLDDQRLSKARKKAARKDMLSLPDQPPTKSGIIRDRILRDEIRKCLRKNGLNPDGFAKAEIKKVVLQGRLRQSSGVPIKSLILLRTIADPIIMPRSVYDPKTGKRVPDPDSQANRVYLGGNNHHIEIRENLQTGKWSGRVVTMFKAAQRVRVHKVEALDRSDGQCRRFVMSLAEGETVHMRHPKTGQPGYFVVFKLDKPQTVHFIHHWDARPSKATQDQPPREDIALPASKIRSLGVQPSKPPCKVRIDPLGQVRPVHHD

SEQ ID NO: 7541 - protein, 1129 aa, unidentified
  REGION 1..1129: note = Description of Unknown:uncultivated organism sequence
MPTTLGLDLGPNSIGWALIDSDRIIDLGVRIFPEGVDNFDTKKEKPRNEDRRDARMMRRQTRRRADRRRELRQTLTHVGLFPAEDAEQHTLYQLDPYELRTRGLTEKLSLPEIGRVLLHLNQRRGFRSNMKRERANDAEVKGMLAEIAGLEKELNGRTLGQYIHERHQADPLARTRGIHTQRSMLMDEFDRIWAEQAKHHPELTKQLAYGKLGKLKDIHKPIPKSDPRRNGDSDLKSFGLYGMIFFHRTLKPVPKEVIGACELEPKRKRCPKADRLAQRFRLLQEVNNLRLLDNSASPPVERPLNDQERALVIDKLMGTKEATFDQIRKWIAKLPDSPTEEQIKFNLEEGKRKKLKGMVTDALLAAGGKNGAVGKSWYDLPEDSRDRAVRLLIDNVDDDETHEVLVNECGLTPEEADSALSVDLTAGPTAGYVRFSRFAIEKLLPHLERGLRLMANDESDSAMHAAGYMRRDQVPRRIFDELPDPGRIHDAPIGDIPNPVVKRAIVELRKVVNAIIREYGRPEAVHIEMAREVQQGQKKRAERTSKMREIEAERDDAKQMLHDLNLGYGSRGTNIVRVQLWKQQHHTCPYCGQKISQTQLFNDGQVDIDHILPYSRSLDNSQMNKVVCHRECNASKGKQTPYEWKASTDPAGFEQMMQYTKHLPYPKRKRFIQKELELDNFIARQLNATGYIAKATVEYIKRLFENEHQVLGLKGQLTAELRRQWGLNDAIRDDGLDLKTRDDHRHHAVDAVVVAMTDRSRLQQLSRIQKRGGVLATGEALDEPWPNFRDEVVSKIAMLDGGDDGTGQKRGVSHRVQRKIAGALHEETSYGPTRDTLGNTVDGTFVVRKPIDALSPNEVDKIRDEQIRLLIKERLSQHGIDVGRGKKADPKQWKQALCDPDNPIVLPPSKKRLKKDPSAQGTPVRKVRVLREEKTIQPIREDQAKQQNNPDLIAYVKPGSTHHLCIYEFMHKGKKKRDAVFVTQLEATNRLKRQQQELAKRIEQWKRDGLDKREIKQRQSKAMREIAAEYPLIQRDASKLTGDDRNRIPANASFVMSLAQGELVLADWKGEQKILKFKTAASTQGQIYFALHTDARKSSEYTKHVATANSLSARKITIDPLGRIRWASD

SEQ ID NO: 7542 - protein, 1129 aa, unidentified
  REGION 1..1129: note = Description of Unknown:uncultivated organism sequence
MPTTLGLDLGPNSIGWALIDSDRIIDLGVRIFPEGVDNFDTKKEKPRNEDRRDARMMRRQTRRRADRRRELRQTLTHVGLFPAEDAEQHTLYQLDPYELRTRGLTEKLSLPEIGRVLLHLNQRRGFRSNMKRERANDAEVKGMLADIAGLEKELNGRTLGQYIHERHQADPLARTRGIHTQRSMLMDEFDRIWAEQAKHHPELTKQLAYGKLGKLKDIHKPIPKSDPRRNGDSDLKSFGLYGMIFFHRTLKPVPKEVIGACELEPKRKRCPKADRLAQRFRLLQEVNNLRLLDNSASPPVERPLNDQERALVIDKLMGTKEATFDQIRKWIAKLPDSPTEEQIKFNLEEGKRKKLKGMVTDALLAAGGKNGAVGKSWYDLPEDSRDRAVRLLIDNVDDDETHEVLVNECGLTPEEADSALSVDLTAGPTAGYVRFSRFAIEKLLPHLERGLRLMANDESDSAMHAAGYMRRDQVPRRIFDELPDPGRIHDAPIGDIPNPVVKRAIVELRKVVNAIIREYGRPEAVHIEMAREVQQGQKKRAERTSKMREIEAERDDAKQMLHDLNLGYGSRGTNIVRVQLWKQQHHTCPYCGQKISQTQLFNDGQVDIDHILPYSRSLDNSQMNKVVCHRECNASKGKQTPYEWKASTDPAGFEQMMQYTKHLPYPKRKRFIQKELELDNFIARQLNATGYIAKATVEYIKCLFENEHQVLGLKGQLTAELRRQWGLNDAIRDDGLDLKTRDDHRHHAVDAVVVAMTDRSRLQQLSRIQKRGGVLATGEALDEPWPNFRDEVVSKIAMLDGGDDGTGQKRGVSHRVQRKIAGALHEETSYGPTRDTLGNTVDGTFVVRKPIEALSPNEVDKIRDEQIRLLIKERLSEHGIDVGRGKKADPKQWKQALCDPDNPIVLPPSKKRLKKDPSAQGTPVRKVRVLREEKTIQPIREDQAKQQNNPDLIAYVKPGSTHHLCIYEFMHKGKKKRDAVFVTQLEATNRLKRQQQELAKRIEQWKRDGLDKREIKQRQSKAMREIAAEYPLIQRDASKLTGDDRNRIPANASFVMSLAQGELVLADWKGEQKILKFKTAASTQGQIYFALHTDARKSSEYTKHVATANSLSARKITIDPLGRIRWASD

SEQ ID NO: 7543 - protein, 1129 aa, unidentified
  REGION 1..1129: note = Description of Unknown:uncultivated organism sequence
MPTTLGLDLGPNSIGWALIDSDRIIDLGVRIFPEGVDNFDTKKEKPRNEDRRDARMMRRQTRRRADRRRELRQTLTHVGLFPAEDAEQHTLYQLDPYELRTRGLTEKLSLPEIGRVLLHLNQRRGFRSNMKRERANDAEVKGMLADIAGLEKELNGRTLGQYIHERHQADPLARTRGIHTQRSMLMDEFDRIWAEQAKHHPELTKQLAYGKLGKLKDIHKPIPKSDPRRNGDSDLKSFGLYGMIFFHRTLKPVPKEVIGACELEPKRKRCPKADRLAQRFRLLQEVNNLRLLDNSASPPVERPLNDQERALVIDKLMGTKEATFDQIRKWIAKLPDSPTEEQIKFNLEEGKRKKLKGMVTDALLAAGGKNGAVGKSWYDLPEDSRDRAVRLLIDNVDDDETHEVLVNECGLTPEEADSALSVDLTAGPTAGYVRFSRFAIEKLLPHLERGLRLMANDESDSAMHAAGYMRRDQVPRRIFDELPDPGRIHDAPIGDIPNPVVKRAIVELRKVVNAIIREYGRPEAVHIEMAREVQQGQKKRAERTSKMREIEAERDDAKQMLHDLNLGYGSRGTNIVRVQLWKQQHHTCPYCGQKISQTQLFNDGQVDIDHILPYSRSLDNSQMNKVVCHRECNASKGKQTPYEWKASTDPAGFEQMMQYTKHLPYPKRKRFIQKELELDNFIARQLNATGYIAKATVEYIKRLFENEHQVLGLKGQLTAELRRQWGLNDAIRDDGLDLKTRDDHRHHAVDAVVVAMTDRSRLQQLSRIQKRGGVLATGEALDEPWPNFRDEVVSKIAMLDGGDDGTGQKRGVSHRVQRKIAGALHEETSYGPTRDTLGNTVDGTFVVRKPIEALSPNEVDKIRDEQIRLLIKERLSEHGIDVGRGKKADPKQWKQALCDPDNPIVLPPSKKRLKKDPSAQGTPVRKVRVLREEKTIQPIREDQAKQQNNPDLIAYVKPGSTHHLCIYEFMHKGKKKRDAVFVTQLEATNRLKRQQQELAKRIEQWKRDGLDKREIKQRQSKAMREIAAEYPLIQRDASKLTGDDRNRIPANASFVMSLAQGELVLADWKGEQKILKFKTAASTQGQIYFALHTDARKSSEYTKHVATANSLSARKITIDPLGRIRWASD

SEQ ID NO: 7544 - protein, 1364 aa, unidentified
  REGION 1..1364: note = Description of Unknown:uncultivated organism sequence
MPVYLGLDIGSNSVGSAWIDTTDRSITPGVSIFPAGVDESDDKRGEPRNAKRRMARRTRITLARRAERKRLLRLQLIEARLLPREAAEFKILLENTDPWELRRKGLDGQLTPHEFGRVLLHLAQHRGALGLKIADPDESEPDGDAEDGKVKAAIGEVRAKMLRRKARSFGEYIALVRAERVTPITSEDRRAVHARKGPREYRDAVRNKAGSYEHCADRDMVRDEFQKLWHKQVELGGDTARLLTNQLCTALDDESGDSLWVHKGLLFGQRRQSWDLGTLGRCVLEPTERCVPHADMYASRYLVVETVNNLKIIERGKEARPLTPQERQKIKDYLSGPLGIEKGRRKKGDTEPPKDKPKTTVSVTDLRNLMGWGRASKTSPFRLNIESDEERTINTDWFSREIIHGAVTPAKWAEMPPSVREGLNRAILKFDPDRDADAAKIRNGAMSWGGLDEAQADALVGAWKKRPRVDAKRLNMSRRAVRNLLTLMDRAEPWPDTSQPRCPRWLTQIEARKLIAEDADYKDATTGGPLDLQARMRYATGAKGATARDRYYMQKHLLLKNGKPVFGPDGLPLAEPPPAPLINNPVVRKAIHEVRRHLVEYMTTFGRKPDAIYIELAREARMGKMAADKLLFRNRLRNRIRNDIVAAFDLDTLSSTQQRAAVDRVILAVQQGGVCPLCGNQAVPTEITPRMAAFGAGCDVAHIIPKACGGHNGLGNIVLGHTKCNRDMGRRTPRQFWEATIKGGFEEGMRYVEGIYQDVDRPKPSEVKNASGNALWSCYFAGRPSRFGPTFDELKIEQFKKDISDIQEMTPRQSAATSYAARQVMTYLADALYGGKGLPERSTGADTDDRERRIFATDGLWTSRLRWEWGLRFDPHQSRAKGLTDQQEHHRKEKDRGDHRHHAIDAVVIALCSAQVQRAWDDREKCADRDGMNTADEVAMKNYRRRNPLPVPPPFGSQEEFREAVRLAVFGEVAVERPICHRPVKRKLIGALHEETLLGPVLDNTGRLTQNFTAQKSVLALDPNHLRMPRLETSQEAIERLAHRRLRQADGDERAARKWARQVVLSAGYKPAIIDPPPEKSGIVRDIALRARLRECLTNAGLDPDDFSANQVKKVVESGGLRQASGIPIRSVVLLRTMKDPAIVSRWASEHATGKRCRVYDATTGTGDAAAARAYVGGNNHHIEIRAAKSKKGEETWSGEIVTAFEVAQRKLAKLRAFRKAGIPKPDAFRKLLRAERAKLTPTLRAIEAAHPLVDRCDNDAKGGKFIMSLCEGEMLLMKHKVGGEVGYFVVAKLDKPQSIVLVPHWDARAAGERKDSEGTKVPDSKRDQFAATPGDLKSLAPPGRAHAIKVCVSPIGAVTEVCD

SEQ ID NO: 7545 - protein, 1199 aa, unidentified
  REGION 1..1199: note = Description of Unknown:uncultivated organism sequence
MKVLGLDIGSNSVGSAWVDTERRFIRMGVSVFPAGVESTQDKRGAPKNQSRRSQRQQRRSIERRAKLKRRLRQYLIRKHWMPTDKEEVQKWESVNPWILRRDALHRELSEYEFGRILLHLAQRRGSWWFDEEPEEGEEKKKKKEKDPIETPGTIEYTKTMIIGKGAETFGELIAIEYENRRTATKNKNEKEEVKKRSERVRNRANAFGEKVSEFVADRHMILAEFLRILERQKSFGGKLAEQLTDQMKKEIYNPQKTDTWRCQGVLFSQRKAYWNPGTLGRCDLEPTDEKCPKADMYAQEFLVLTSVNNIRITPRMEASRRLTAEEREKVITAVRKQKTASESTIRKALGIDKGANKTHYMLNIDGDKFTVNGDWFYSQIVYKVFGEDTWGRFDEKMKESVNRAVLKFDPKDESDEERIRAGCKNWWNLKSEQIKKFVAAWKGRPKKDSRVNLSRKAIKNLLPYLRDGLSVTEARDMYAHKMDELTRNRYSTREVVVNKRIRHFQGRHPDLLPPVSDGISNPVVRKSIHEVRRHLMEYIKQYGRPDRVVIELAREARQSEKVISRRIQKNKAIDALRKEIIETHKLDVSEITSTQRERAIKRVRLCRQQRGMCAYSGVTITDAGAAAGEGLEIDHIVPRSKGGDNGMSNLVLCYATANQGKGKRTPIDWLSKEDFEKLEQIFRHLQGAKKLKRSKESHPATTKDNVDMVNKRKWENLHRRTPEKGFTEEQLRSSAYAATQTSDWISKVLYGGEDSGKRYVFASNGNYTGILRRDWGLFFDESGERSERGRKLRGDHRHHSVDAAIIAMSAQCLQSIKDSFVDFERQKENKNVKARWKTVDEPWDGFSKQIVDEYKKLKVSHRAYNRQIAGHLHKDTLYGPAIIYERHKKDDKKKGIGKGDLKRDKDGKPIVKKGMYIKCIPVIGIKQNHLRMPDDWDRLKKEYGNATIGSEKKAIRKEMLGLEDVPPGKSGVIRDIELRDKIGEWLKEHEFADMGKAKAYLKENGLNINGTPVRKVRLLWKLKGMTPPIRRKGFDYENSTLEARRKSLRFYQTQNNHHIEIREKVTKKGEIRWSGDVVTNFDAAKRVRTNNEPIIDNGENEKAKFVMSLSRGEVVHMRHPETREVDYFVVFKIDGTGAIHFTRHTDANPASSKEKGVKLREDIALVPDKLRENIMFDERDVPEKVRISPLGEVKVLVKD

SEQ ID NO: 7546 - protein, 1207 aa, unidentified
  REGION 1..1207: note = Description of Unknown:uncultivated organism sequence
MSKNGTQKVLGLDIGASSLGWALVQLPTNGKTCGKIIKAGSHIFQAGMEGFDSNKEKSKNEPRRKSRGSRRRTRRLSQRKHQLAVLLRENKMFPSNIEKETSDPYELRKRGLEEKLTREELGRVFYHLCQRRGFATARKTKVVKKTSKKKDAEETKSDPGHPNKEEKKIDILANISELADNIEKSGEKTLGAYLSAKREENALVRIRGRHTRRSMYKDEFELLWNFQAKYYPKFLTNGLKQRVESLIFHQRPIYWKESSIGQCELEPNEKCCLRADRLAQEFRLLQEVNNLKYIDTDTNREIRVAETAGYPKLIDMMNEKKEVSFDQIRKVLGLESFVRFNLEAGKKSSGSGKKRAKKASATDSSENGHSAQNESSAENGENGGRSKLKGMETDYILKGNKYFGTLWKKKSEEEKNEIVRILCERRDKIGKYIDEERLREIIVNDWGVGDGENADNLLDVADEFPQGRLNLSRKAIEKLLPFMRQGKLFTGDPETDALHAADYLRPDERPWKRVDFLPPLELKNRKPKMITDEAVREAVEALKNLPAITNPVVRQCVSEVRKLVNTIVREYDRPDKIRVELAREAKANSQQRKAIQDNNKKNRNENEEADKFIQEKGYTPSFDRRLRYRLWKEQKELCPYTQKPISVSQLFGSETDIDHIIPRAQGGEDARTNKVVCFRAANQEKGNRTPWQWLNDADPIRYEQVLSAAQKNLPYIKRIRFSQQEGNLENFVDRQLNDTKYASRYVKQYLNLLYDKDGSLHVQTIRGNQTAALRHLWGLNSILHEDIVPNDLKPDQKNRADLRHHAVDALVIALTDAAMIQKLATWDDMNKLADLKNKPLPPWPSEEAFRQEAAESIRSIIVSHAPNRRVRGQLCEETKYGFVKKRASGDERNLVRRKPLADLSPSEVLNIRDETIRRKVLEYLENKHGIRLNKKGTKLNCSKKTLKAALSIPFYLHPEEKRTPIKKVRVLVSQATAIPLYPDRKDSPQIIPGNTHHIRIFEWVEKNKKGEDELVREVFFTTQLEVNRRNVERYRLIRSQMRDLPAELLQDERELKIREILRNAALQFPIIERTLSQEESLGHDAEKAVFVMSLSKNETLEITDIEVDKLTEDNPKTTLVLFKTGAATSKQLFFSDIRSGFKKPKKSEGEETNEETDSGDELLEEEEQNSSFGKYGKNAVERFSVSLKRIYRKVHIDILGNIYPAGD

SEQ ID NO: 7547 - protein, 1277 aa, unidentified
  REGION 1..1277: note = Description of Unknown:uncultivated organism sequence
MAVILGLDIGSNSVGSAWVDTDAREIHLGVSVFAAGVDEQENKRGAPKNQARREKRSQRRSLARRSARKRHLRALLIQAGLLPRNPDELQKLFELNRWPPPTEPDALKRMLRDSYTVWHLRRDALSRALHPYEFGRVLVHLNQRRGAVGIVSDPEDEDEGKVKEAIDRLAALMNKRGAETVGQLFADLMTERRKTNGQNGQCWHEPIRNRQYRMKEEDQLYADRRRIREEFTKLWDRQKSFGGELAALLTENLKKKLDDPTQDDTWRHRGVLFGQRRTYWDTGTLGRCDLEPTERCVPLADMYAQEFRVIETVNNIRVAKRGEPEAALTKEDRQKVIDALRRQKTGSVATIRKALGIDKKGIREFYSLNIERDPNREINTDWFYREIVHGVVGESTWSTWDQSRRDSLNRAILKFDPDDEDHEQKFRAGAARWWGLDAAAIDRLIVSWKGRPKLEKRLKLSRRAIRNLLPYMNQFDVVHKRWPTQIEARQRFAEDGEALDRTTGQPVTKEQRQRYALGAKPATRADRQYLRKHDAPLPPAPMLANPVVRKAIHEVRRHIIAWWRRFGRIPDRIVIEYVRSATQPAKLRNEVLALNRRREAIRKQIVEEYGLGGLSKTQQARAIERVLLCRQQKGLCPYCGDMNPITERVAVDGQVVETDHIVPMSRSQDNSLNNKVLCHRSCNRGKGNQTPKEWLHAGSPEFQRLEQRLQHLEKGECPDGYFTKRDCGRKWDNLHRDAPSTGEFLASQFTDTAYAARQVGRWLREVLYGAERDGDRHVFTTKGSYTSILRNDWGLSESDLDRRWHDIVEPGETERDNQSRRARKQKNKDRADHLHHAIDAVAIALAPDRLQDLARHAEEQERARAELGYWPRRKPLAPPWPPVPAGATEEAVSRATAAFREQVLAAADRLVVSHRPVKRRLVGAFHEETAYGPVVEPLPRHRREDPSTLFTNRIQAAALTPNHLRVPDGWDILSARLEDPALTDAEKKTIRRQLADLIDPPPGKSGIVRDRALRDRIRKSLRANGIDPDNFSRDQIKGLVAAGRLTMTSGIPIKSVVLLRTNTDPVVIPRKRWDPAANRMVPDPDPRTARVYIGGNNHHIEIREDPKTGKWSGEIVTAFEAARRNAARLQAIRRAGVPPAEQLRSMPRHERERFGDVVADINRRFPVVDRSDNDKGRFVMSLAEGETLHMRHPDTDQAGYFVVFKLDKPNTIHFIHHWDARPSQPRKDDDGKPIPNSQREDIRVVASRLKTLGVEPGQPPYKVRVSPVGEVTRLTGD

SEQ ID NO: 7548 - protein, 1353 aa, unidentified
  REGION 1..1353: note = Description of Unknown:uncultivated organism sequence
MITLGLDIGSNSVGSAWLDSATGDLTTGISIFPAGVDESDDKRGEPKNAKRRMTRRTRITLARRAQRKHLLRSALVEAGLLPSDEAGFKSLLDSTDPWALRRKGLYEALTPYEFGRVLLHLSQRRGALGLKIANPDDPEADDSKAADDGKVKAAIGEVRSKMLHKNARTFGEFIAMIRDERVHPIETPDQRRPLERKGKRVFRDAVRNKSGGYEHCADRSMIRDEFAKLWSAQKNLGGPTAALLTDTLRLKLDDESGDATWRHKGLLFGQRRQTWDLGTLGRCVLHPTERCVPHADMYASRFLVVETVNNLKIIEKGKEARALTPEEREKIKTYLSGPLGLEKPRKSKGQKEEPVPRPKATVSVTDLRNFMRWGKATKSSPLRFNIEADKDRLINTDWFNREIVHGAIGVEAWDRMDGRIREGINRAILKFEPEDDAHHLKLKYGVMSWAGLTEQQADALVAVWTRRPKTDAKRLNISRRAVRNLLTVMDSPEPWLDSKREGQSKWLTEIESRKLIAGDGVFKDVTNGQEFDELTRRRYATGAKGATARDRYYMRQHLLTKDGEPIYGPDGLPLAEPPPAPMVSNPVVRKAIHEVRRHVVAYMTRFGRKPDEVYIELAREARMGAKDSDRLLFKNRLRNRIRNDILRELDLESHTTTQQRAAVDRVVLCIQQNGVCPLCGNQVVNTRLTSRMAAHGEDCEIAHIIPRASGGHNGLGNIVLAHTKCNREMGRRTPREFWSQLFKGGFDESLRHVEGIYGDIQRPKPSEIKNANGDALWSCYFTQREDHGKINQFKKDIKDIQEMTNRQEAVTKYASRQVMAYLADALFDGKGLPERSTGPSEGGDNKRRIFATDGMWTSRLRREWGLFFDPHGFKSKGLSNEQEHERKEKNRGDHHHHAIDAVVIALSTRNTQIAWEDREKKADKQLTNPADEVEMENYRRRNPLSPPPQYNSRDEFREAVRKSIFGQGQPGRPICHRPAKRKLTGALHEETLFGPILDEQGQLTGNYTARKSVLNLDPNHLECPRPETEKQAVERLTKRRIRSQGIDDKSARKWAKATVASPGFKPLMIDPPPGKSGLVRDPDLRKRLRQCIEEAGMDPDKFTSSQVKKLFEAGKFCQASGVPIKSVVLIRVMSDPVIINRKRPDHETGRLVRDTNPTSQRAYVGGNNHHIEIRVAKNKKGVEKWSGQIVTTFEAAQRKLAKLREFRKANIPKPVEFKKLTKADRAKLTPTLRRIEQDHPIVDRNDDDAKGGRFVMSLSEGETLLMKHKDAGEVGYFVVAKLDKPQGIVLVPHWDARAAGERKDSEGNKVPDSKRDSFTATPNDLTTLAPPGHPHAVKIHVDPLGQATVLERD

SEQ ID NO: 7549 - protein, 1331 aa, unidentified
  REGION 1..1331: note = Description of Unknown:uncultivated organism sequence
MAVYFGLDIGSNSVGSAWVDDVTGQLTTGTSVFPAGVDESEDKRGEPKNAKRRMTRRTRITLARRAKRKRELRVKLVEVGLLPASPAEFKALLEAADPWELRRKGLDGPLSPFEFGRVLLHLAQRRGAVGLYAADADEEETDGASKDDGRVKKAIRQVQAKMADKNARTFGEFIALVRAERVTPITSEDRRPLSKRRGPREWRMAIRNKAASYEHCADRTMIRDEFARLWDAQKKFDTDTARLLTTELRLALDDESGDTIWRHKGLLFGQRRQSWDLGTLGRCVLEPTDRCAPHADMYASRYLVVETVNNLRIIERGKEVRPLTPEERDKIKAYLSGPLGMEKGRRKKGASAPPPDQPKRTVNVSDLRHLMGWGRASKTAQFRFNIENDEERVINTDWFSREVIHGAFGVESWDALSERQRDSVNRALLKFDPQREDDAGRLRAGAQQWWGLDADRADRLIEAWKGRPKLEKRLNLSRRAILNLLPYMERFDHENNRWPTQQEARKAHAEVLRQQFEQTGDCAYEVSARRYATGAKGATARDRHYMKKHLLMKNGQPIIGPDGLPLHEPPPAPLISNPVVRKAIHEVRRHLVEYMTTFGRKPDGVCVELAREARMGKVDADRLLLKNRLRSRIRNDIIREFNLESRSITQQRAAVDRVVLCVQQNCVCPLCGQAGLSPRQAASGDGCEVAHIIPRASGGHNGLSNLVLAHTKCNREMGRRTPRQYWSDGPGFERGLAWVESIYGDIERPKYSEIKSATGNSLWVCYFTQRDDQQKIEQFKKDITDIQEMTPRQEAATKYATRQVMAYIADALYDGQGLPERGGERRIYATDGLWTSRLRREWGLFFDPHDARAHGLPTGDEHERKEKNRGDHRHHAIDAVVIAYCTRQVQIAWEEREKQADRDGINTADEEAMETYRRQHPLGPPPPFKTREDFRAAVKRAVFGDGEVERPICHRPVKRKLIGALHEETLFGPVLDHAGNLTDNYTAKKSVLALDPNHLRMPRPETEQEAVDRLAARGRRTKHVDERAARRRARAVVSSPGYQPAIVDPPPGKSGIVRDVALRARLRQCLEEAGLDPDDFSANEVKKLFESGAIKHASGVPIRSVVLMRTVSNPVVIDRKRPDYPSGQMLPDGHAASKRAYVGGNNHHIEIRVATDEKGQEVWSGEIVSAFDAAQRKLARLRALREAGIAKPEDLRRLAEPERRRLAPVLRSIEAAHPLVDRRDDDARGGRFVMSLCEGETLYMKHKQTGETGYFVVAKLDKPHSIVVVPHWDARAATERKDAEGRKVPNSKREQFAVTPSDLKALAPPGYDHAVKVRVSPLGKVTVLQRD

SEQ ID NO: 7550 - protein, 1005 aa, unidentified
  REGION 1..1005: note = Description of Unknown:uncultivated organism sequence
MSELTLGLDLGPNSIGWALIDESAGQIVGAGVRVFPEGVDRDNKGAELSKNETRRNARAMRRQIARRARRKRALRRALVDAGLLPPCALLPPDDAQRVAWETAEFKKACPYSLRRRALSERLEPYEIGRVLLHLNQRRGFRSNRKTDRARRKETSAMLAEINDLAAKMGNRTLGEYLAETRAGDPHVRVRGHHTRREMYLEEFERIWSAQQPHHPDILTPERKAAIHRIMFFQREMYWPASVIGRCELEPRLPRCPRADRRAQRFRLLQEVNNLRLLDTTTGEERALNEEERTKLVAFLAGAKEKTFDAIRKHLFGRTEGIRFNLERGDRDKLKGIPTDALLAQKDLFGKAWYTLSEQDKNRLVAALIEEDEHCIRQTAAQLGLEPDLTEKLLEVPLEEGYASYSLHAIKKLLPHLERGLRLSSRDGSPCALREAGYILPWERRSDRQAYLPEPPEVTNPLVRQALHEVRKVVNAILRELVYRPGHRLARIHIELAREVRGTAEQRERRSRERSARERARSAAAEEIQKAGAKPTRDAIDRYLLWQEQGRECVYSGRAIGIVQLLGGEVDIDHILPYSRSLDNSLMNKVVCFRSENNQGVNPAAKGDRTPYEWLAASDPAKYEQVLQRADRLPYPKARKFRQKSVELDDFFARQFVDTTYITTQVHQYVQCLGADVLCVKGQHTADLRHFWGLDSVLRDDGLNLKNREDHRHHAVDAIVIALTDRSRLQQLARLRRGRRDEPRDDFLPEPWTNFRAGVEQIVNAINVSHRVRRKVAGPLHEETVYGPTATPGEFVYRKPVESLTPQMVESIRDPVVRAIVIERLRAHGIEPGSDRRIPSEVWKEPLQMPSGVPIRKVRLVRRDLTIQPIRAGTAYVKPGSLHHLCIFEYSENGKTKRDAVFVSMLDAITRLKRREPVVQRTHPTRADAKFLMSLSRGEMVVATFQGKERLVCFRTAASTQGQIYFVAHTDARTSADTKKLVAKASTLKARKVTVDPIGRIRWAND

SEQ ID NO: 7551 - protein, 1043 aa, unidentified
  REGION 1..1043: note = Description of Unknown:uncultivated organism sequence
MADLTLGLDLGSNSLGWALLDEEGGRIVAAGVRVFPEGVDRDTSGAEISKMQQRRIARAMRRQIARRARRKRRLRRALVDAGLLPEAALLPRTDPQRSAWEDSAFRAADPYELRARALTTRLEPYELGRVFLHLAQRRGFKSNRRADRAQRKEQSPMLEEINTLAAELNGRTLGQYLAELRGTDPKCYHEVRLRGRHTQRDMYEHEFDRIWAAQAPHHPTLLTDERHKELKDVIFFQRNLRPPSPALVGRCELEPRLPRCPRADRRAQKFRLYQEVNNLRLIDSSVGVERALTPDERQRVLDLLRRKKDCKFEDLAKLLFPDHPDNIRFNLQRGDRKALKGLPIDVALAGKKFIGKAWHSLSEDVKDRIVASIVHPATPPKPRSNKSDSGPPSPNDRDPEKEHLQVILKEAGLDPDLAPRLLDGVPLEDGYASYSVHAIKRLLPHLEAGLPLTSRDPQTPCALRAAGYLMPWEHVAERRPMLPEPPPVTNPLVRQALHEVRKVVNAVLRELVYRAGHTLARIHIELAREVRGTARERAQRSREMREREAQRKQAAERIREQGVRPTRDAIDRYLLWEEQGGVCIYSGRAISLAQLFGGEVDVDHILPFSRSLDNSLMNRVVAFRAENAAKGDRTPQEWLAADPQKREQVLQRARHLPYPKYRRFLQRDVSLDDFFARQFVDTTYITTQVHQYVRCLGADVVCSKGQHTAELRWQWGLDTILAELPESPANDAAADLPPGQKNRADHRHHAIDAIVIALNGRQRLQQLAALRRAGGTAATGEILPEPWPDFRASVRAAVQTIHVSHRPRRRVSGALHEETLYGPTQTPGEFVVRKPLTALSLSEVERIRDPAIRRLVTARLKQFGLEPGRAKGGRISPEVWAEPLCLPSGVPINRVRIIKKDQTITPIRGGTAWVKPGAVHHVEVFEFRRGPRTLRQGRFVSLLEATQRLRARQPIVQRTWPEHPDARFVMSLCPGDMLLPRWDSSERLLLVSTLVSTQERIHIVDARDARPSSKRCDVGKTPNSLQAIKVTVDPIGRIRRAGD

SEQ ID NO: 7552 - protein, 1301 aa, unidentified
  REGION 1..1301: note = Description of Unknown:uncultivated organism sequence
MISLGLDIGTNSVGSAWVDTETREITVGVSVFPAGVDEADDQRGAPKNQKRREKRSQRRTIARRSERKRRTRRLLVRFGLLPADQKSLLELLKIDPWLLRERGLREGLSPHEFGRAILHLCQRRGALGLKLPAENQSESEDADQEAKDDAKVKAAVEFTKQRMRELDVATFGQLMAEEMRRRSHPILSATGEPRVDAHDKPRTFQSEPIRNRLASFQFHADRSLIRDEFLRLWKRQTKKCGALAHLSDDQRAELLLALDNPARNAKWRHQGALFGQRASYWNAGTLGRCTLEPTDRCVPIADRHASYYRVLESVNNIRIQGPGDRQPRPLTPLERDKVIERLRTPKSGTPAAIRAALGIDKRSLKKQRLPESAWWLNIEIDKDREINTDWFHCEVVDALGREEWNRWPENKREGLNRALLKCDPADPDDEKRLRDILQRMGIDEATRDRVIGAWKTRPKLEKRLNLSRRAILNLLPYMERQLPDGRWPTQIEARQMFADDRTNGATEAQRRRYRIGAQTLTKADRHYMKKHSGELPPAPMLTNPVVRKAIHEVRRHVIAHLRAHGGRRPDRICVEFAREAKKFKKEIDWILNLNRKRERIRKQIIEEVVKPAWGNRFHTLSHNQLQEAVNRVILAQQQRGLCAYSGDKYGLINPSVAALGEGLEIDHIVPRARGGSNAWSNLVLCWRKSNRDKLNRIPREWWGADFDERSRPMAFMNGYEPPKGDPNQFFTKKDYAAKWLNFSRDEVPQEWRGSQLTDTAYAARQVQSYLQSALWPNEPSHLEGGPRRIFVTIGAYTHQLRKDWQLFQRIIKPGEATTEKVQEAALKNRGDHREHAIDAVAIAFTAIPANETLEPDAAGRVRTRIDDLAYHQQAQEKEWQRARMEGRDPRGIKRDPLPVPWGDIRSFRQQVLSRIYGDFEGCDGQSDPAAADSPRPLVVSHRPAGRRILGALHEETLFGPVPGLEKTYVGRKSVLQLTPNHLRMPVPESKQDSIKRLATEYLERGLFKSRGEAKAAATRQVESASFTPPLVDPPPGKSGLVRDRDLRRRLRECIAAFEYVEKDREGNIKRRYFLDPDTFTPKEIRQAVEAGAIKHASGVPIKRVKLLRTMNDPVIVHRKRWDHERNCWVRDTGKDGDLAPDQCSRADRAYVGGNNHHIEIRQDAHGRWNGQIISMFAAARRVRHEKRPAVDRSDNPDLGGEFVMSLAAGETVCMLDEETGQAGYFVVVKLDKPHTIHFIRHWDARRATGEKDADGTLRPGSQRVTIDKTASQLRDLAPPGHDFPFKVRVSPLGEVMPLLKD

SEQ ID NO: 7553 - protein, 1054 aa, unidentified
  REGION 1..1054: note = Description of Unknown:uncultivated organism sequence
MANLTLGLDLGPTSLGWALLDEEGGRIVAAGVRVFPEGVDRDSNGAEVSKMQQRRLARAMRRQIARRARRKRRLRRALVDAGLLPEVALLPRTDPQRSAWEDSAFHAADPYELRARALTTRLEPYELGRVFLHLAQRRGFKSNRKADRAQRKERSQILEEISTLARDLNGRTLGQYLAKLRGTDPKCYHKERLRGRYTQRDMYEHEFDRIWAAQAPHHPTLLTDERRKELKDVIFFQRNLRPPSPALVGRCELEPRLPRCPRADRRAQKFRLYQEVNNLRLIDSTAGVERALTPDERQRALDLLRRKKDCEFKELAKLLFPEHPDNIRFNLQRGDREKLKGLPIDAELAKKKFIGKAWHSLPEEVKDRIVASIVHPATPPKKGPDRKEDQNPTPSNGKEDHDPPQKVDPEVEHLKHVLEKAGLDPDLAPRLLDELPLESGYASYSVHAIKRLLPHLEAGLPLTSRDPQTPCALRAAGYLMPWEHVAQRRPMLPEPPQVTNPLVRQALHEVRKVVNAVLRELVYRAGHTLARIHIELAREVRGTARERAQRAREMREREELRNQAAERVREQGVRPTRDAIDRYLLWEEQGRVCIYSGRPISLAQLFGGEVDVDHILPYSRSLDNSLMNRVLAFRAENAAKGDRTPHEWLAATDPQKWEQVQQRARHLPYPKYRRFLQRDVSLDDFFARQFVDTAYIATQVHQYVRCLGADVVCSKGQHTAELRWQWGLDTILAELPDSPANDAAADLPLGEKNRADHRHHAIDAIVIALNGRKRLQQLAALRRAGGTAATGEILPEPWPNFRAAVRAAVESINVSHRPRRRVSGRLHEETLYGPTQTPGEFVVRKPLTELSLSEVERIRDPAIRRLVTARLQEFGLDPGRAKGGKISPAVWARPLCMPSGVPIRRVRVIKKDQTITPIRGGTAWVKPGNVHHVEIFEFHQGSRTFRRGRFVSLLEATQRLRARQPIVQRTWPEHPDARFVMSLCTGDMVLARWDGSERLVLVSTLVSTQERIHIVDARDARPSSKRCDVGKTPNSLQAIKVTVDPIGRIRRAGD

SEQ ID NO: 7554 - protein, 1352 aa, unidentified
  REGION 1..1352: note = Description of Unknown:uncultivated organism sequence
MAIYLGLDIGSNSVGSAWIDTHNKTITPGVSVFPAGVDESDEKRGEPKNAKRRMARRTRITLARRAERKRLLRWKLIEVGLLPRDAGEFKTLLDNTDPWDLRRKGLDEALSPHEFGRVLLHLAQHRGALGLKMPDPDDADSPDLADEGKVKAAIGEVRAKMLQRKARTFGEYIAMVRAERVTAITTEDRRPLNARRGPREYRAAVRNKGRSYEHCTDRDMIRDEFGKLWEAQVKIGGDTARRLTQDLRTALDDPTGDSEWVHKGLLFGQRRQSWDLGTLGRCVLEPTERCVPHADMYASRYLVVETVNNLKIIEWGNEARPLTPEERQKIKNYLSGPLGTEKGRKKKGDTEPPKDRPKTSVTVADLRNLMGWGRVSKTSQFRFNIESDKERTINTDWFSREIIHGAVTPEKWAHMSERVREGLNRAILKYNPDNEADAAKLKKGVMAWGGLDEAQADALVAAWRKRPRPDAKRLNMSRRAVRNLLALMDRDEPWSGRMRWLTQPEARRRIAQDADFKDVTTGQPLDWYARMRYATGAKGATARDRYYMKKHLLLKNGKPIFGPDGNPLAEPPPAPLISNPVVRKAIHEVRRHIVEYMTTFGRKPDAIYVELAREARMGKKAADELLFRNRLRNRIRNDIIGAFELDRLTSTQQRAAVDRVVLCVQQGGVCPLCGNQRVTTKITPRMAAAGEGCEVAHIIPRACGGHNGLGNIVLAHTKCNRDMGRRTPRQFWEAALPGGFDEGMRFVESIYRNVERPKPSDLKSATGDSLWACYFAGKPSRFGPTFDELKIEQFKKDVTDIQEMTPRQEAATKYAARQVMAYLADALYGGRGLPERGGEHLIYATDGLWTGRLRREWGLFFDPHQRKAKGLNEQQEHERKEKDRGDHRHHAIDAIVTALCSRQVQIAWEEREKQAEREGVNTADEVEMENYRRLHPLDPPAPFKTREEFRDAVAKAVFGDGQVERPVCHRPVKRKLIGALHKETLFGPVLDEAGRLTDTYTAKKSVLELKPNYLRMPRPETTNEAVERLTARRLRRNGGDERAARKWARGVVASAGYKPRIIDPPPGKSGIVRDVALRTRLRECLTAGGIDPDDFTANQIKKLVEAGGLRQASGVPIRSVALLHTISDPVIVSRWASDHATTKRRKLYDAATGQGDASAARAYVARNNHHIEIRAAKNKKGEEVWRGEVVTAFQVAQRKLAKLRAFRQAGVPRPDVFRGLPRAERARLMPVIRAIEKDYPLVDRSDDETKGGRFVMSLCEGETLLMKHKATGEVGYFVVAKLDKPQGIVLVPHWDARAAGERKDAEGKTVPDSKRDQFTATPTDLLKLAPPGRPHAVKVRVSPLGEVREVHD

SEQ ID NO: 7555 - protein, 1242 aa, unidentified
  REGION 1..1242: note = Description of Unknown:uncultivated organism sequence
MPTYLGLDIGSNSVGSAWVDTERRQIHLGVSVFPAGVDEQDDKRGPPKNQARRQTRSQRRTIHRRAERKRKLVRFLADHGFLPRDAGELQRLFDASPWVLRRKALREELSPHEFGRVLVHLAQRRGAVGVTSDPDDPDEGKVKEGMDRLDKLMRERTVGQLLADLSEERQRSNGSVTWNEPIRNRQYRMPPDQQLFAGRDLIRAEFRRMVEVQRSFRNSELCGKLTDELVQELDDPRQTDTWRHRGLLFGQRRTYWDTGTLGRCGLEPTERCAPIADRHASYFRVVETVNNIRIETRGQGERPLTVEERDKVIRLLRGPLGERKQKGKLVPKTSVSVTEVRHALGLGKKVKGDPVQLNIEADQDREINTDWFHREVVHAAFGEERWNSMPEPLRESVNRAILKFDPDQPDDEKRLREGARDWWTLDDAATDRLLAAWKRRPKLEKRLNLSRRAILNLVPYMEKFDAANNRWPTQIEARKAYATTLSDEHARRRYATGALGLTAADRYYMRQEKHQLKDDDGQVIRDENGRPLPEPPPAPMLSNPVVRKAIHEVRRHLLAWMRKFGRKPDRVVIEFARGVKDTAKRCNEQLAANRERDSERRLIEEDLRSWGIPESNWNRATLRVRLCREQKGICPFSLEGANANRIITERIAAEGGDVEIEHIVPEGLTGKTMAFNNLVLCFREANRGKGMRTPAGWLGPERLKAMLKRLENTPVKNNRIKWERLQAPTPDEEGFRNAQLTDTAYAARQVAAYIADALFEGQGLPERGGERRIFTTKGEYTARLRADWGLHESTIDRVHGLESSPTAEELAQDPHLQQSSRRARKEPKDRRDHRHHALDALVTATIGPELLTELGRMARQDREYRERTGHWPRRSPFPQPSAWETPEAFHEDVVAAFERLIVAHRPLKRRLVGAFHEDTLYGPVVAPLPPHRTEKPDTLFTNRISADRLTANHLRVPEGWDELSAKLDDGRVSAAEKRDVRRKLAAMEDPSPGKSGIVRDRALRDRIRKCLRANDVNPDDFSKADIKRLCDVNDWKLRMASGVPIKGVVLLRTNTDPIIIPRKQWDPAMGRMVPHMDPDDPSKPHPRTKRVYIGGNNHHVEIREDANGKWTARIISTFDAARRVRPPKNADGTRPEPQPAVDRSDNDDRTFVMSLAEGELIYARRKDRPAESPDYYVVCKLDKAGNSCRIHFAPHWDARKASEQDRWDVMPGDLKNCGPHPGEPPCKVRVGPLGDVTRLKRD

SEQ ID NO: 7556 - protein, 1079 aa, unidentified
  REGION 1..1079: note = Description of Unknown:uncultivated organism sequence
MSRTVLGLDIGPNSIGWALVDSEAHRIVDMGVRVFPEGVDNFDTGKEKSRNEDRRIARGMRRQIVRRAHRKCRLRDALIDAGLFPANAVDQEALYRSNPYELRARALDHCLHPYEIGRIFLHLNQRRGFLSNRKRDRGDKEISGMLAEISQLEQQIQESGARALGEFLYRKYQSFSHANRVDNDHVRKRHTRRKMLELEFDAIWDAQAKHHPHLLTEKLRYGVLGCVSYPCKPRRKPRGMTDLEAFGIHGIIFFQRRMYWPKSVVGLCELEPKEKRCPRADRHAQRFRLLQEINNLRFIDPDATQERPLADQQRALLPDHLATRKKASFDQIRRKLGFLESVRFNLEAGKRTHLQGMTVDCLMADAVGKTWHNRPEDEKDVVVRLLLDNQREDDAVTERLITEFAFTPQQADAALNVDFPTGYSHLSLKAIDRLLPHLERGLVYQSVSDPEQSALHAAGYLRRDELQRRLFDELPDPTRVRLQDCRLGDIPNPVVKRALVELRKVVNAIIREYGKPDEVHVEMARSLPLGINGRKEYNKRIREQELRRDRAADEIRQYRQRYPDSGVRVNRESILRFLLWEEQAHECVYCQRAISQHQLFGGEVDVDHILPYSRSLDDSQSNKVLAHRQCNRDKGQRTPYEWLAETDPQRYDRICRHMGSLLQKKLIPYGKYRKFLQKELDLDQFIARQLADTGYIARATAEYLRCLFESDHHVLGLKGQHTAELRRQWGLNSVLRHDAVDMKNRDDHRHHAVDALVVALTDRRLLQRLARGFVERSRVDPDSGEQRYRQSYAGRRIDEPWPGFRAQVEDRVNRINVSHRPMRKVAGRLHEETIYGPTPEPGVFVVRKPLEELSASEIPLIRDEGVRRLIERRLAEHGIEIGRGKNASAKTLKHVLCDPANPITIPPSKKRLRRDPQAKGIPVRKVRLLRSDLTIQPIREQTGNTAFVKPGATHHLTIFEWEANGKTKREAVFVTQLEAIRRIAKGIEVIQRNPPQDHPTIPSDARFVMSLSRGEMVLATIGEEEKLLVLVTAVSTSKQLRFAEHTDGRRQRIWRFSPNTLQARKVTVDPIGRIRWAND

SEQ ID NO: 7557 - protein, 1209 aa, unidentified
  REGION 1..1209: note = Description of Unknown:uncultivated organism sequence
MSIFFRVIFLGEIKMDILGLDIGVSSVGSAWVNTENGTIRLGVGIFPEGVAKKKDGSLGAAKNQDRREKRQQRKQLGRRSDRKKQLRKKLVKWGWIPGNFVEVLKWERLNPWRLRREALERELAPTEFGRVLLHLIQRRGASWFEDVKGSPKKKEENDGEQNQKKTPKLDPKGANLKLRELMKKTKAETYGACMSILKDKRIIELKNKKDETVCIHNSIRNRNNAEGNPVFEFCADRRLLIDEFLLLWERQKSFGGSLAEQLTDNRKEELYKSKGTNTWKTQGLLFGQRNTYWDTGTLGRCDLEPTDQCCPKADMYAQEFLVLETANNIRIIPPGQYARPLNKEERAKVIQTLETQKTASASTVRTALGLGKEIALNLEHDKNKKLNTNWFKSQVVAAIGLEIWNSMDLTRQNGVNKAILKFDPKDIDDKKTLVQGCRDWWGFDENQTQAFIQAWENRPKKEARLSLSRKAIQNLLPYMRQYEGCSVTEARQYFAEDGDNGATNQQRERYSLAYNRPNKHLRQYMQKHPDLLPPPPMIANPVVRKTIHEVRRQIIEHIRQAGGVVPEQIIVELTRDAKHSAVVRDRLNDAMKKNREKRAKIKKEFPDEIANQNLTRTQERKAIDRVILCRQQKEQCAYSNLDKMEARPIDPRQAARGEGLEIDHIIPQSRGGSNSLSNKVLCYAATNRGKGNKTLREWLGEDSFARMEQRFGHWKTDRELKRKWEILHTESLSMEDYIQNQLTDTAYAATQVIQWLQQALYGGCHDGKRHIFPTTGRYTGLLRKEWGLFYSERNPDAEEKSRDDHRHHALDAVVVAFSGPERIRQLAEISQRLELAHEKGETLPREEMRIPAPKPWKDRDSFRAQVIEQVKNLVVSHRPEKQKIVGRFHKETQYGPILDENGELTDEFTQRIFIGKLNPKNHLRVPEHWDTLREKLELAKTKKEKHDIQKQMLALDDVRPGKSGVVRDRWFREELRQCLRKNGLDPDSFSNGKTDKEEDKKHFRHLIREGKICLPSGVPIRQVTLRKVFNFRAEIPRKRIDPVTGKRIVDKNPKSMRVYELQSNHHIEIRENPKGKWVGDVIPTFDAVRRVRPPKAPGQKPRPAVDRSDTKKGKFIMSLCIGETVYMKHKDSEKPGYFVVFKVDSGKSGRIHFTHHWDAGKDKADETHPARADISLSPSQLQALGAEEGKPPVKVWVSPLGKVKVLHRD

SEQ ID NO: 7558 - protein, 1084 aa, unidentified
  REGION 1..1084: note = Description of Unknown:uncultivated organism sequence
MKRVLGLDLGTNSIGWAVLDVPEHENPEENTGTVVAMGSRIFTQGAEEAGSALETPAKVRRAKRSMRRQIQRRAKRRQRIRHELTAIGLLPDGDLEFDDLMKEDPAALMQSSTEGAVLSLREIGRVIYWFSSQRGFLSLRAGGGDTTDEDDDRATRNRYRNPQTVKETGEIKVRGQENILVDFLYQQAQHHPALLTDEIIFGARGRLTYPVRPIKQGNFLSDGDSWLGEFGIHGLVFFQRSVYWDQKTIGTCSLDPRKGGPRVLRADRNAQKYRVWKNVLDLRVETPQRSLSDGERKVVYDTLMTQGSVSFNSLRKKLKLPDDAAINLALSEREELKGNETDAAMRKTLGDAWEEMDEQTRDNIVSVLLGNALADQVRAVLMGKQFGLTHEQAEAALLVGFPSGRSMFGRHTIKQLLRFMPEGPMASSEALQETLGGVWEALSDTQQDQMISLLLDDAKRSKEKKALSATLASDFGLSSAQIKAVVGVRANESKGIKEERGALIKNERHVIQAAGFRMPEEVRSERPVEIEKLTNPLVRQTLSQLRKVLHAVAHTHGLEGDQPFDVVRIELTRDVRSNYRARKETNQRQRQNEKDNKAAEKMIEDFAPGAKISYDHRRRARLWKEQGEQCLYCGQPISSIEAFTGATELDHILPQSRTLDNSMANLALVHADENQEKGNRTLTEWLGPEDAFEIAMRAKKYIPYPHWKPKMRRIEAIDVADAPVPEALLVQTGYINSVARDFIRQELGMKAEVSSGRITASLLYHTGLKKDGEDHRRHAQDAAIVAICDRRTSLRLAKAYKKKEATGSYSGESEYGGFEPGEGFREQVKACYTDINVSHAVKGKMSGQWHEETYYGKVESPYLEGDDVYAFRRPVSWVTSPKKLAEVADPAVQEALRQNLRDRGLDPEGSSFKFDEKNPPHMPKDKNGDANVINTVRLHVNKPGNKILRPETEPKTGVVMGRNHSAFLYENTETGKWRLHIVTRFDAFLNRGLSLSETRAVHAEEDEEFLFSVTIGAALLLEMDGKDELFFVKSLAPSLQSLDMRPASTTAGNKNIWFRASKLQKFKARKVVVLPNGEVRTARD

SEQ ID NO: 7559 - protein, 1188 aa, unidentified
  REGION 1..1188: note = Description of Unknown:uncultivated organism sequence
MKLLGLDIGSNSVGSAWIDTKTKTIQLGDSVFPAGVEELSDKRGDPKNQARRSQRQQRRSIERRAKLKRRLRQYLIKKGWIPIEKNELQKWQNLNPWILRKDAIHRKLTEYEFGRILLHLAQRRGAWWFDEEPEEKENKKKKKDPAEIPGTVEYTKKIMKQKNAETFGELIAVEYENRKTATGNKDKKRNNRIRNRADAFGNKESEFVADRHMILAEFLKIWETQKSLGGQLAEQLTDEVKKEIYNPQKTNTWRCQGVLFSQRKAYWNVGTLGRCDLEPTDRKCPKADMYAQEFLVLTSVNNIRITPPMEASRKLTAEEREKVISAVRKQQSASESTIRKALEIDKGAAKTHYALNTDGDKFTVNGDWFYSQIVCGVFGEDTWAAFDSNVKESVNRAILKFDPTEEADENKIRKGCKEWWNLDDKQTENFIAAWEKRPKKDSRVNLSRKAIKNLLPYLRDGWSVTEARDMFAEDASNGADDLTRRRYSTKEVVVNKRIRHFQEKHPDLLPPVSEDISNPVVRKSIHEVRKHLMEYIKQNGRPDRVVIELAREARQTAKVIAKRIQKNKAIEALKEEIKNTHNLDEKTTTQKERAIQRVRLCRQQRQMCAYSGVTITDKMAADGAGLEIDHIVPRSKGGNNGMNNLVLCFSTANQGKGARTPIDWLSEENFGRLEKIFKHLHSQEGEKGKRFITKDNVDMVDEAKWKNLHRKTPKEGFTEEQLRSTAYAATQTADWINKVLYGNEDKGKRYVFASRGDYTGILRRDWGLFFDEDGERSEKGRKNRGDHRHHAVDAAIIAMTTPSRLQEIKRSFIDFEKQKENKNVKPQWKTIDEPWEGFSEQLAEEYKKLKVSHRAYNKQIAGSLHKDTIYGPAMIYERHKKDDEKKGIKKGDVKTDKDGNPVFKKGMYIKSIPAIGIKQNHLRMPIGWDKLKEEYRNAKTNPERKAIRKKMLALEDVPPAKSGIIRDIELRDKIRDWLIEHNFEDIGKAKEYIKKNGFIINGTPVRKVRVLWKLKGVKEIPRKSFDYKTGKVVKSKDRKSMRVYQTQNNHHIEIRENEKGKWLGEVITNFDAARRVRADKKPIVDRNENKNGKFVMSLARGEMVHMKHPNTQEANYFVVFKIDSSKAIHFTPHTDANPASSKKKGVKLREDISLVPDDLRQNIIFNEDGVPEKVKVSPLGKVKVLVKD

SEQ ID NO: 7560 - protein, 1258 aa, unidentified
  REGION 1..1258: note = Description of Unknown:uncultivated organism sequence
MAVYLGLDIGSNSVGSAWVDTDKQEVHLAASVFPAGVDEQENKRGAPKNQARRQTRSQRRTIHRRAQRKRQLVRFLMELELLPRDPSELRDLFDLDPWQLRRKALKEALTPHEIGRVLVHLAQRRGPVGVVTDPENPDEGRVKDAMDRLNALMTERSAETVGQLLADLIDERRRPVERLPDHACSRRTRQRRRKRQGRKPNDPQLLPVRNRQYRLPETDMLFAGRDLIRVEFHRIVEAQRAFNGSDLARMLTDDLVKALDDPTQADAWRHRGLLFGHRRTYWDTGTLGRCDLEPTERCVPTGDRHASYFRVVETVNNIRIERQGEPVRPLTADERDNLIRLLRGPLGQRKQKGKLVPKTSAGVTDIKKALGINPRDKSVRLNIEADEQREINTDWFHREIVHGAFGEARWNQLSEQQRESVNRAILKFDPDHEDDARKLRDGAQRWWGLDAAAADRLLDTWKGRPKLEKRLNLSRRAILNLLPYMERFDAGNNRWPTQQEARKAHAKVLQERFEQTGECAYELAARRYATGALGLTAADRYYMRQEKHQLKDENGQVIRDENGNPLPELPPAPMLSNPVVRKAIHEVRRHLLAWLRRFRRKPDRVVIEFARGVQDTAKRRNEQLAANRERERERKQIEENLRAWGIPGSNWDRAVLRVRLCREQGGVCPFSLSGSNATRTITERMAAEGREVEVEHIIPEALTARTMAFNNLVLCYREANRGKGMRTPLDWLGPEGVRAMLQRLEKAPIKENRVKWERLQMPTPDEEGFRNSQLTDTAYAARQVASYIADALYDGQGLPERGGERKIFTTKGEYTGRLRADWGLHESTIDRAHGLEAPPTPEALAADPDLEQASRRARKEPKDRSDHRQHAIDALVTALLGPELLTVVGRQAREDREYYERTRYRPRRKALDPPRAWPTPEAFRDAVVSAFEKLTVSHRPVKRRLVGAFHEETHYGPVIDPLPPHRTENVWTLFTNRISADRLTPNHLRVPQGWDELSARLDDPSLPPQEKRAIRKQLGALEDPSPGKPGIVRDRDLRDRIRKCLRHNALDPDRFTAAEIKKLVADGRLTMPSGVPIKGVVLLRTNTDPVIIPRKRWDAASDRMVIDDDPRTRRVYIGGNNHHVEIRENCKTGIWSAEIVPTFEAARRVRVEGRAAVNRSDDDDARFVMSLAEGEMIHARRNDRPDERPDYFVVCKLDKLGSSSRIHFAPHWDARKASEQDRWDVTPADLKECGPEPGKPPVKVRVGPLGDIKVLERD

SEQ ID NO: 7561 - protein, 1064 aa, unidentified
  REGION 1..1064: note = Description of Unknown:uncultivated organism sequence
MGLTLGLDIGPNSIGWALVDDVEQRIVDLGVRVFPEGVDNFDTRKEKSRNEDRRIARGMRRQIARRARRKRQLREALIASGLYPASLHEQQALSLLNPYELRAKGLDEKLTPHEFGRVLLHLNQRRGFLSNRKRDRADKEVKGMLEEISQLAREIADSGSRTLGEYLFRKSASFDHARRVENDHIRNRHTRRDMLEQEFNALWDAQAKHHPKLLTATLRFGERGAGQYPCKPQSKSGTQSLVQAFGLHGMIFFQRKMYWPKSVVGLCELESGEKRCQRFDRHAQRFRLLQEVNNLRYIDPGTREECRLDDEQRTLLLDYLSRREKATFDEIRRKLGFLETVKFNLERGERSSLKGMVVDWMMAKAVGKEWHDRPEHEKDVIVRRLLDNEREDDLLTEWLVREFGFSRDQAEKAVEVDLPAGYIHLSLKAIDKLLPHLERGLVYQSASDPEQSALHAAGYLRRDELQRRLFDRLPDPRRVRLRDCAIGDIPNPIVKRAIVELRKVVNAILREYGKPDAIHVEMARSVQLGKTARDEYNRRIREREAERDRAATEIRNQGIAVNRESIQRFLLWEQQLHECIYCQRTISQQQLFGGEVDVDHILPYSRSLDDSQNNQVVAHRQCNHDKGQRTPYEWLAASEPQRYETICQHAMSLLQKARIPYSKYRKFLQKELDLDEFISRQLTDTGYIARVAAEYLRLLVEQPHHVLGLKGQHTAELRRQWGLNSILRHDELDLKNREDHRHHAVDALVVALTNRQVLQQLSRATRDRAWRDRDSGEVVHFRQYAGAPLPEPWENFRRDAENAVNKIYVSQRVRRKARGALHAEMPYGPTSNPGVFVKRKPVAELSASEIDKIRDEGIKRLVIAHLQAHGLEFGRGKSVDAKRLKTALSDVRMPSGVPVKKVRLLVPEQTVQPIRSRAAQRHNDETRIAHVRPGDNHHACLFEWEEKGKVKRDAEYVSRLEASRRLRDREPLIRRTHSEVPHARFLMSLCPGDTVLVDVDGQSRLMVVSTLVSTQKRIHLVDSRDARRSSDRLDIGLSPNSLIEKYHARKVIVDPLGRIRWAND

SEQ ID NO: 7562 - protein, 1347 aa, unidentified
  REGION 1..1347: note = Description of Unknown:uncultivated organism sequence
MPIYLGLDIGSNSVGSAWVNTDTGEIVTGISIFPAGVDESDEKRGDPKNAKRRMARRTRITLARRSERKRALRLKLIAAGLLPRTQQEFALLLETTDPWDLRRRGLDEPLHPYEFGRVLLHLAQRRGALGLKPIADDIATDESAVEDGKVKAAIQDVRQKMLDRKARSFGEFIAMLRAERVNPITTKDARAPHRRKGPREFRTAVRNRGGNYEHCSDRAMIQSEFAQLWDAQERFGGETAKLLLPDLRAQLDSPSTDSTWRHRGLLFGQRRQSWDLGTLGRCVLEPTERCAPHADMYASKYLVVETVNNLKIIERGKEARPLTPEERNKIKNYLCGPLGMEKGRKRKGDTKHAAERPKTKVSVADLRELMGWPRASKSSPYSFNIEADEDRLINTDWFSREIIHGAITPAIWESLTQDQREGLNRALLKFDPSEPKDEAKLLQGVTTWGGLSADAAAKLVAAWRLRPNPETKRLSLSRRAVRNLLALMDRDEPWPDPEQPGKTRWLSQVAARRMIAADGDFEDVTTGKKLDDHTRRRYATGTKGATARDRRYLRKHILRENGEPIFDDQGHPISEPPPAPLVSNPVVRKAIHEVRRHVVEYLVRFGRRPDYVCVELAREARMGKRDADRLLFKNRLRNRIRNDILTTFHLDSVSATQQRAAVDRVVLGAQQGWVCPLCGQRDGLTPMNAAHGRGCELAHILPRGSGGDNGLGNLVLAHTKCNRDMDRRTPRQFWEASLPGGFDAGVIWIEKIYSNVERIKPAELKSTTGDALWACYFDTRDDRRKLEQFKKNISDIKTMTERQDAATKYASRQVMSYLADALFGGEGLPERGGQRRIFTTDGIWTSRLRREWGLFFDPHQKRAKGLSNTQVQERKEKDRGDHRHHAIDAIVIALCDSSLKARWDERERQADRERINTADEAQMDSFRKSHPLLPPSAFSSVGGLRAAVQEAVFGHEKQERPICHRPVKRKLIGALHEETLFGPILDRAGQLTSYFTARKSVLSLTPKHLRLPRPESTDQAIARLAARRQQAKGVDSKTARNWAKEVVASSSFIPRLVEPLPEKSGIVRDIALRKRIRQCLSEAGVNPDSFSTNELKKVVEQGALRQASGVPIRSVVLLRAMSDPVIVPRKRPDYETGKLLPDDNPASMRAYLSGNNHHLEIRVSKDKHGKDIVRGQIVSAFEAAQRKLARLRAIRMAGVPKPSKLRRLPKKERLQWRTVLKSIDAANPIVDRRYDDAKGGQFLMSLCEGETLWLRQKPRKKGDPCGDASYFVVAKLEKGDNAVLVPHWDARAAGEQKDSSGNKVPNSKREQFSITPSDLKTLAPPGHPFAVKVRVSALGKVTVLKND

SEQ ID NO: 7563 - protein, 1258 aa, unidentified
  REGION 1..1258: note = Description of Unknown:uncultivated organism sequence
MITLGLDIGSNSVGSSWVDLSKREAHLAVSVFPAGVDETEDKRGAPKNQARRQTRSQRRTIERRARRKRLLTIALMERGLLPRDPGALGELYGRDPWQLRRRGLSEPLTPHDFGRLLVHLAQRRGAVGVISDPENADEGKVKEGMDRLEALMRERRAETVGQLMAELIHERRREHNGTAWHEPVRNRQYRMAETQQLFAGRESIRREFHKLVAAQRSFHDSPLSKLLADELVRELDDPRKSDTWRHQGWLFGQRGTYWDTGRLGRCVLEPAERCAPIADRHASYFRVLEIVNNIRIVTPGIGARALTADQRSNVLQLVRGPLGERRYKGALVPKTSVSVGDIREKLGLSRRRRRADAVQLNIEADEERELNTDWFHREVVHGAFGEDTWNSMTEATREAVNRAILKFDPSEPGDAERLLAGAKRWWALDDAAAERLVSAWKQRPRLEKRLNLSRRAVRNLIPYMEQFDEENGRWSTQQEARKAYAKLLRAQFEETGESWVELAARRYETAALGLTAADRYYMRQPKHQLRDEHAAIIHDSDGNPLPVPPPAPMVSNPVVRKAIHEVRRHLVAWMRKFRTRPDRIVIEFARGVKDTAKRRNAQLAANREREKERKLIEENLRAWGIPESNWDRAVLRVRLCKEQAGVCPFSLQGPNASRTITEKMAAEGADVEREHIVPEGLTGKTMAFNNLVLCFREANRGKGMRTPLDWLGPEGVKAMLQRLENAPIKGNRSKWKRLQEPTPDEAEFRNSQLTDTAYAARQVAAYIADALYDGDGLPERGGLRRIFTTKGEFTARLRADWGLHESTIDRESGLEAAPSAEAVRTDPHIEQAFRRARKDAKDRSDHRHHAIDALAIALVGPELLNEVARHAREDREYRERTGHWPRRRAIEQPSAWPTLEAFHEDVLAAVRRLVVSNRPVKRRLAGAFHEAEHYGPIIGPLPAHRRERLDTLYTNKVAIYANSRNYLTPNHLRVPERWDELSSKLEEAAFSDAQKRAIRRELAAMPDPPPAKSGIVRDRALRDRIRKCLRGNGLNPDDFTAAQIKQLATEAKVTMASGVPIKSVVLLRTNTDPVIVPRKQWDPAAGRLLPHMDPDDPSKPHPRTKRVYIGGNNHHVEIREDSRGRWSGRIVSTFEAAQRVRPAANPDGSKRPAQPAVDRASNAAGDFVMSLSEGEMMFARRKDRPDGPADYYVVCKLDKAGNSCRIHFAAHWDARKAAEQDRWAVAPADLKACGPRPQAPPEKVRVGPLGGISVLVRD

SEQ ID NO: 7564 - protein, 1026 aa, unidentified
  REGION 1..1026: note = Description of Unknown:uncultivated organism sequence
MSDLTLGLDLGPTSIGWALINEDGREILGCGVRVFPEGVDRDTRGTEISKNAQRRLARSTRRQVARRARRKKRLRRALVAAGLLPSCAGLPREDAERNAWERDQFRHADPYVLRSRALKERLEPHEIGRVLLHLAQRRGFHSNRKTDRARAKETSEMLAEISELEAQLNGRTLGQYLHELRGDDQANHHLVRLRGRHTRRDMYKREFDAVWQAQQAHYPDMLKDDLQLRLHGEIFYQRSLHRPSPSLIGRCEVEPRLPRCPRADRRAQRFRLFLEVNNLRLIDAATGVERPLTTEERNNLLAYLASTKERTFEQIRKKLFDRPESIFFNLERGGRTKLLGMPTDDVLAKPRLLGKSWHKLDESLKDRIVAAILDADEERLPHVLGQAGIDAARADDLLDAPLEEGYASYSLHAIKKLLPHVERGLPLTSRTGDSPCALREAGYLMPWERAIEQKPELPAPPTVTNPLVRQALHEVRKVVNAILRELVYRPGHRLARIHIELAREVRGTARQRHERSQEMRARERDRDKAAERIRELGHRPTRDAINRYLLWQEQGEQCVYSGRMISVAQLFGGEVDIDHILPAGRSLDDSLMNKVVCFRSENSQGVNRNAKGDRTPHEWLAANDPEKYEQVLQRAKKLPWHKLKRFGQQSLDLEDFFARQFVDTTYITSQVADYVHHLGADVICPKGQHTATLRRLWGLDTILCDLGDSPAWREALELARGEKNRLDHRHHAIDAIVIALSDRSRLQRLASYLDARDSRASDLRLAPWPQFRATVETVLRDIKVSHRPRRKVAGALHEATMYGPTASEGEVRVRKEVTALSCSEIESIRDPVVRSCIMARLAKYGITPGRGGDKIPAEVWREPLWLNEEEQIPIRRVRLKKKDESIVSLRRGTALVKPGSVHHVCIFEEKKQGKTRWYANYVTMLEAARRVRQHEPIIQRADAGNPDARFVMSLCKGDLLLTEYQDNERLVVVSTMVTTQKRIHVVDANDARPGAKKKDIGKTANSLKGARKANVDPLGRVRWAND

SEQ ID NO: 7565 - protein, 1354 aa, unidentified
  REGION 1..1354: note = Description of Unknown:uncultivated organism sequence
MIRLGFDIGSNSVGSAWVDTATGQLITGTSIFPAGVDESDEKRGDPKNAKRRTTRRTRITLARRSQRKRELRLKLIEVGLLPVDPDTFKALLDRTDPWELRRKGLDHALTPHEFGRVLLHLAQRRGALGLNIPDEPEDGESAADAEDGKVKAAIGEVRAKMRERNARTFGEFMAMVRAERVTPITSEDRRPISKRKGPRLYRGAIRNKAASYEHCADRAMIRAEFAALWDAQRACNPEMSRVLTDDLRTVLDDESGDSVWRHRGLLFGQRRQSWDLGTLGRCVLEPTERCAPHADMYASRYRVVETVNNLKIIERGREPRPLTPEERAKIKDYLSGPLGMEKPTKKRPDPRPKTTVSVTDLRNLMEWGRSSPTAQYRFNIENDEDREINTDWFSREIIHGAVTPATWRSMPESIREGLNRAILRHDPDQDGDAEKLRQGVMSWAGLSESQANALVEAWKRRPRLDSKRLNISRRAVRNLLALMDRDEPWPDPHRPGQNRWLTQIEARKLIAEDADFRDVTTGLPPDEHARRRYATGARGSTARDRYYMAKHILMKDGKPVIGPDGRPLAEPPPAPLVSNPVVRKAIHEVRRHIVEYMMTFNRRPDEVSIELMREARMGAKDADRLLFRNRLRSRIRKNIVEEFNLGGLTSTQQRAAVDRVVLCMQQGGASAICPLCGKHDGLTPRNAAHGNGCEVAHIIPRASGGHNGLGNLVLAHTKCNREMARRTPRQYWNETVSGGFEEAVSWVEKIYGNIERPTLKGNKDVKGDGLWSCYFTKRDDAAKIEQFKKDIKDIQDMTARQDAATKYAARQVMAYISDAIFDGKGLPERSTAAGAPDGDRTIFATDGLWTSRFRREWGLYFDPHGKRAKELSESEKHERQEKDRGDHRHHAIDAIVIALCDRRMQVKWERREKEADQAGVNTADEEQMENYRRQHPLQPPEPYRTRDEFRDAVRRAVYGDTDVARPICHRPVKRKLIGALHEETLFGPVLDASGNPTSSYTARKSVLALTPNHLRVPEGWDELSVQLDDPNVAESRRREIRRRLIELSRNDPPPGKSGIVRDRTLRDRLRKCLRSAGLDPDGFTANEIKKAVDAKHLQHLSGVPIRSVVLLRTMTDPVVIDRKRPDHATGRMIRDDAPASRRAYVGGNNHHIEIRVSRDKKKREVWTGVIVSAFDAAQRKLEKLRAFRQAGIPKPTAFRALSQPERDRLSPILRSIELAHPIVDRRDDDSKGGCFVMSLCEGEMLFMKHKERDELGYFVVAKLDKPNRIIVVPHWDARAAGERKDAEGNKVPDSKRESIALTPSDLLTLAPPCYPTRSGKPPTRPGGSPWSDAPPHALKVRVSALGVVTVLDRD

SEQ ID NO: 7566 - protein, 1006 aa, unidentified
  REGION 1..1006: note = Description of Unknown:uncultivated organism sequence
MRKRLGLDLGSNSIGWALIDPDKPLLLDAGVRVFPEGVDRDRSGGEVSKSEKRRVCRGARRRTARRRKRVAHVKRLLIANGLLPEVAGRKSTDPDRQEWEKTTFAQSSPYQLRGRALDEKLAAHEVGRAILHLAQRRGFWSNRKATGAERKEESETLAEIEQLQKDIDQAECRTLGEYLGKLHQSNALQRLRGRHTRRRMYKHEFETIWSAQQKHHPELLTEVLKGEIHHAIFHQRPLKIPKSMIGTCELETNRRRCPRADRRAQRFRLLMEVNNLRVVDQNGEDRPLTGDERAVLIEYLSSSDRRTFDQIRKKLGFNGQCVFNLERAKRKSLQGHRTDTAMKKALGRSWAKLDEEKRNTIVRSILEDSPAEIAKRAVQEWNLNDQQAQLLPAIELPQGYSAFSREAINKLLPHIEAGHPLMSSDDRPCAITLAGYLRPDQRPQKRTESLPQPPDLPNPIVRAALHEVRKVVNAVLRAHGPIDEIHIELTREVKGSLARREEHIRRMRQREKLRDAAADAIRQAGFQPSRESINRYLLWEEQERHCIYSGKPISMAQLLGGAVDVDHILPRSRSLDDSLMNKVVAFRADNADKGNRTVWEWLGESAPDRYDEILLRARKWLAEGKLPYGKFRKLQQKNVELDDFIHRQLNDTAYITRAVAEYLRCLVENPHRDMLATKGQLTAKIRHAWGLNEILRDDGLNLKTREDHRHHAIDAIVTAFVDRSLLQQLSRLDTEIKPPTESFRQDVETILNNMNVSHRVRRGIQGALHEDTHYGPTDQAGVSVYRKPVESLTLNEVEHIRDEAVKRKVIRRLEEFGLTAGRQKKGAGSSNKIPGEVWAETLWMNQDKEIPIKKVRIEKTDATVQPIRAGSVEVKPGNTHHVAIFELPDGKRVPLFVTMLEAAKRARQKGPNGQTVSIVQRNHPDYPEARFIMSLSSTELLLANWKGQSRLLQFRTCAQTQGQLYFADARDARPASQKEKFVANANTLDARKVTVSPLGELRWAND

SEQ ID NO: 7567 - protein, 1006 aa, unidentified
  REGION 1..1006: note = Description of Unknown:uncultivated organism sequence
MRKRLGLDLGSNSIGWALIDPDKPLLLDAGVRVFPEGVDRDRSGGEVSKSEKRRVCRGARRRTARRRKRVAHVKRLLIANGLLPEVAGRKRTDPDRQEWEKTTFAQSSPYQLRGRALDEKLAAHEVGRAILHLAQRRGFWSNRKATGAERKEESETLAEIEQLQKDIDQAECRTLGEYLGKLHQSNALQRLRGRHTRRRMYKHEFETIWSAQQKHHPELLTEVLKGEIHHAIFHQRPLKIPKSMIGTCELETNRRRCPRADRRAQRFRLLMEVNNLRVVDQNGEDRPLTGDERAVLIEYLSSSDRRTFDQIRKKLGFNGQCVFNLERAKRKSLQGHRTDTAMKKALGRSWAKLDEEKRNTIVRSILEDSPAEIAKRAVQEWNLNDQQAQLLPAIELPQGYSAFSREAINKLLPHIEAGHPLMSSDDRPCAITLAGYLRPDQRPQKRTESLPQPPDLPNPIVRAALHEVRKVVNAVLRAHGPIDEIHIELTREVKGSLARREEHIRRMRQREKLRDAAADAIRQAGFQPSRESINRYLLWEEQERHCIYSGKPISMAQLLGGAVDVDHILPRSRSLDDSLMNKVVAFRADNADKGNRTVWEWLGESAPDRYDEILLRARKWLAEGKLPYGKFRKLQQKNVELDDFIHRQLNDTAYITRAVAEYLRCLVENPHRDMLATKGQLTAKIRHAWGLNEILRDDGLNLKTREDHRHHAIDAIVTAFVDRSLLQQLSRLDTEIKPPTESFRQDVETILNNMNVSHRVRRGIQGALHEDTHYGPTDQAGVSVYRKPVESLTLNEVEHIRDEAVKRKVIRRLEEFGLTAGRQKKGAGSSNKIPGEVWAETLWMNQDKEIPIKKVRIEKTDATVQPIRAGSVEVKPGNTHHVAIFELPDGKRVPLFVTMLEAAKRARQKGPNGQTVSIVQRNHPDYPEARFIMSLSSTELLLANWKGQSRLLQFRTCAQTQGQLYFADARDARPASQKEKFVANANTLDARKVTVSPLGELRWAND

SEQ ID NO: 7568 - protein, 1198 aa, unidentified
  REGION 1..1198: note = Description of Unknown:uncultivated organism sequence
MKLLGLDIGSNSVGSAWIDTEEKTIKMGVSVFPAGVEEHTDKRGEPKNQARRRQRQQRRSIARRAKLKRRVRQYLIEKEWMPVDAEKLQKWENLNPWLLRRDAVKAELKTDGHFTGGQKFGRILLHLAQRRGAWWFDEETEEDEGKKKNDPTEKKGTVEYTKAVMKRKGFATFGELMACEYEARVTVTKNGRRRNERVRNRNDEFGQKVSEFVADRHMILDEFQKIWETQAGFRGELGEQLTDAAKEELYNKKKTDTWRCQGVLFSQRKAYWDLGTLGRCDLEPTDEKCPKADMYAQEFLVLTSVNNVRITPPGEESRKLNPKEREKVIQRVRRQKTASEGTLRSALGIDKGVNKSAYTLNTDDDKFTINGDWFYSSIACGVFGEEAWGSLDDKMRESVNSAILKFDPTDEDDEKKLRAGCKKWWNLDSEKAEKLIEAWKKRPKRDQRVNLSRRAIINLLPYLRDGWSVTEARDMFAEDATNGADEATRARYSTKKVAVSKRIRTFQKKHPGLLPPVDEGISNPVVRKSIHEVRKHLMEYLKEYGCPPDRVVIELAREARQTAKVVSERLHRNKAIDELRKEIIKTHNLDAEYVTTTQRERAIQRVRLCRQQRQMCAYSGDTITDKKAADGDGLEVDHIVPRSKGGNNGMSNLVLCYASANQGKGHRTPIDWLSKTDFEGLEQRFRHLKPEEKKGRRFITKDNVDMTDNRKWENLHRRTPREGFTEEQLSSSAYAARQVSNWINKVLYGTEDRSTRYVFASRGDYTGILRRDWGLFFDDAGERSEKGGKNRGDHRHHAVDAAVIAMTPQHFDRIKRSFADLEEQKEDKSIEAKREAVEEPWEGFSKQLAHEYKNMKVSHRAYNRQLAGYLHKDTLYGPAVVYEKHNKDDEKKGIKRGDLKRDKDGQPLLRKGLYVKSIPAANIKKNHLSMPDGWAELKDEYDKANTQVRRRTIRREMLALEDVSPGKSGVIRDIELRDKIRDWLEEHNYESIEKAKGEIKKHGLVVNGTPVRKVRLLWKLNEVVEVPRKHFDQKARRFQTKNACKSKRVYQSQNNHHIEIRQKTSKNGEIKWTGEVISNFEAARRCRTDGSGIVNRADSHNGQFVISLARGEIVHMNHPNTGRSDYFVVFKIDRTGTVHFTAHTDGNPASSKDKKVKLREDIALVPNDLHKYMIFTEDGIPEKVRISPLGEVRVLERD

SEQ ID NO: 7569 - protein, 1010 aa, unidentified
  REGION 1..1010: note = Description of Unknown:uncultivated organism sequence
MANLTLGLDLGPTSLGWALIDENQHKLIATGVRAFPEGVDRDPSGAEISKNEQRRIARGTRRQTARRARRKRKLREALVEAGLLPPLAMLPNDDPQRIAWERDEFRKNGGDPISLRSRVMTERLEPFELGRVFIHLNQRRGFKSNRKTDRSKKKESSEILDEISDLAAQMGERTLGEELARRRGDDPGSFHLTRIRGLHTHRDMYEREFAAIWAAQQKHHPNLLTDVLREQVHRIIFFQRPLLPPSVGLVGRCELEPRLPRCPRADRRAQRLRLYQEVNNLRVLDTAARTERTLAPEEREKLIGYLFKAKDRTFDQIRKHLFEQHASIQFNLEAGGRTKLKGLPTDAALARKGMLGPKWHKLPEELKDRIVAAIIDDEEDRLRHLLVEGGLDSELALTLLDQVNMEDGYASYSLFAIKKLLPHLERGLPLTSRDEQTPCALRAAGYVMPWEYAAETQPYLPEPPNLTNPLVRQALFEVRKVVNAILRELVYRPGHRLARIHIELAREARGTAEQRRKRSLDMHDRERERDTAAGAIREANIKPTRDAIDRYLLWKEQEQVCVYSGRSISFAQLLGGEVDIDHIMPRGRSLDNSLMNRVVAFRAENARKGDRTPHEWLAKSDPEKYEQVLQRARQLPYPKLRRFYQESVELGDFFARQLVDTTYITTQVYQYVCSLGADVLCIRGQHTAELRRHWGLNTVLRHDQLDLKNRDDHRHHAVDAIVIALTGRSRLQQLARIYREGGTETTGEILPEPWQDFRADVELAVNNINVSHRPRRRVSGGLHEDTLYGRTNQPDIYVLRKPLEALSLNEIEKIRDPGIRRIVSERVRNFGLDPGRGKGSKIPADVWKERLRMPSGVPIRRVRLLKPDKSVVPIRGGATYVKPGEQHHVEVFELELGGKTKRYGRFVTRLEAYRRIRNRIQLVQKTDPENPAARFIMSLCTGDMLWAEFDGQERLVVVQTLVSTQPRAHIVDANDARPSTKKRNVGKRIGALRARKVTVDPLGRIRWAND

SEQ ID NO: 7570 - protein, 1196 aa, unidentified
  REGION 1..1196: note = Description of Unknown:uncultivated organism sequence
MKLLGLDLGTNSVGSAWIDTDKKIIKMGVGVFPAGVEESEDKRGAPKNQDRRKNRQQRKSICRRSMLKRNLRQYLIKKKWIPTEKTELQEWYNLNPWILRKNAIEKELTEYEFGRVLLHFAQKRGAWWFDEEPEETGDTKKKKKDLSEVPGTVEYTKRKMKEKDAETFGKLIAIEYEARKTDTANNKKRNNRVKNRNNALGDKEMEFVADRHMILDEFLKIWAKQKSFNGELARQLNLPDAQKEIYNKQKTDIWRCQGVLFSQRKAYWNLGTLGRCELEPTDEKCPKADMYAQEFLVLTSVNNIRITPPGQETRKLDTPEREKVITAARKQKTVSESTVRTALGINKGENKALYTLNTDGDKFTVNGDWFYSQIVHDSFGENVWKSFNQNVKDSVNNAILKFEPNEEEDEQKLVAGCKKWWNLDDAQTGKFINVWKKRPKKDTRVNLSRKAIKNLLPYLRDGWSVTEARNMYAEDATNDANNLKRKRYSTKEIAVDKKIRHFLKKHPDMLPPVSDGISNPVVRKSIHEVRKHLMAHIKQFDKPDRVIIELSRKTRQSEKVIAKKMQINKAIDALTKEIIEKHNLNDGTITSTQKEAAIKRIRLCRQQRYVCAYSGVIEDKPYSCAYSGKSITEEQAKTGEGLEMDHIIPRSKGGNNGMSNLVLCYSTTNQGKKDRTPIDWLTEEEFGRLEQRFKHLKDEQDNYITKDNVDMSDKAKWTNLHRRTPKEGFTEEQLSSSAYAATQTTDWINKVLYGSQDRNKRYVFASNGDYTGILRRDWGLFFDEEGNRSEKGKKFRGDHRHHAVDAVVIALAPLFFQKIKESFIDFEKQKENKNIKPQWKTIAEPWEGFSQQVADEYKKLNVSHRAYNRKITGYLHKDSIYGPAIIYDRYQKDNEKKGIKKGELKRDENGNLVLKDGMYIKSIPVIKIEQGHLRMPNDWHSLKEEYKSAMANKKEIKKKMLALEEVPPAKSGIIRDIDLRDKICDWLKDNNFSEMKEAKKYIQENGLVINGTPIRKVRVLWKLNEVVEIPRKSFDYETGEFVKCEDRKSLRVYQTQNNHHIEIRESIKGQWNGDVITNFDAAKRARVDKKTIVDRNDTESGRFIMSLAKGEVVSMRHPATQNANYFVVFKIDSTGTIHFTKHTDANPASTKKKNVPIREDIDLTPQKLQKLGVAPGSVPYKVKISPLGEVRELIRD

SEQ ID NO: 7571 - protein, 1199 aa, unidentified
  REGION 1..1199: note = Description of Unknown:uncultivated organism sequence
MKTLGIDIGTNSVGSTWIDTDKKIIKMGVSVFPAGVEESEGKRGAPKNQARRTQRQQRRSIERRAKLKIRLREYLLEKKWIPTEKEKLQKWENLNPWLLRRDAVREELKKDDNFSAGEKFGRILLHIAQRRGAWWFDEEPEETENGKKKEKKDQAEIPGTIEYTKKVMKERGAETFGELIAIEYENRKRNTANKKLRNDRVRNRANALGEKESEFVADRHMILAEFLRIWEIQKKFVGKLAKQLTKEVKEEIYNKKKTNTLRCQGVLFGQRKTYWDLGTLGRCDLEPTAEKCPKADMYAQEFLVHTSVNNIRITTPAESIRKLNNEERSKVVKAVRKQQTASEGTIRKALGIDRGANKTLYTLNTDGDKFTVNGDWFYSQIVCDAFGEDVWASFDNKIKNAVNGAILKFDPNEEDDKAKISAGCKKWWNLTDEQTEKFISAWRKRPKKDQRVNLSRKAVKNLLPHLRDGWSVTEARNMYAEDASNGADDLTRKRYSTKEIFINKQIRHFQQKHPGMLPPVSEGISNPVVRKSIHEVRRQMTEYIRQYGKPDRVVIELARRARQSERVIAKKIKKNKAIDALKKEIIETHNLKAQGITSTQREAAIQRVRLCKQQREMCAYSDATITDAMAVDGSGLEVDHIVPRSKGGDNSMSNKVLCYATANQGKGDRTPIDWLKKEEFRHLELRFKHLAGSKKDKYAITKDNVDMVDNAKWKNLHRKTPKEGFTEEQLRSNAYAATQTADWINKVLFGSEDKNKRYVFASNGDYTGILRRDWGLFFNEDGERSEKGRKLRGDHRHHAVDAAVIAMTIQCLPKIKESFIDFEEQKENKKIKPDWKTIEHPWEGFSEQIAEEYKKLKVSHRAYNRKITGHLHKASIYGPAVIYERHQKDDAKNGIKKGDIKIDKDRNPVLKEGMYIKSIPAIGIKKNHLRMPNDWDKLKDEYKAATTKSLRKAIRKKMLAIEDVPPAKPGIIRDVELRDKIRDWLKEHNFSDMEKAKAYIKENGLIINGTPVRKVRVLWKLNEVKEIPRKKYDFESGSIMKDNNYKSLRVYQTQNNHHIEMREKVNKKGEVKWSGEVITNFDAARRVRAEKKPIIDRNENKNGKFVMSLARGEMVHMRHPDTKEANYFVVFKIDSSKAIHFTAHTDANPASSKQKGVKLREDIPLVPDMLRQHIIFSENGTPEKVRISPLGEVKVLISD

SEQ ID NO: 7572 - protein, 1198 aa, unidentified
  REGION 1..1198: note = Description of Unknown:uncultivated organism sequence
MSFYTLGLDIGSNSVGSAAVDLERRLIRMGVSVFPAGVEEQTDKRGAPKNQARRSQRQQRRSIERRAKLKRRLRQYLIKKNWIPTEKNKLQEWQNLNPWILRKDALHRELTDEYEFGRILLHLAQRRGAWWFDEEPEETEETENSKKKKKDPTETPGTVEYTKAIMTQKSAETFGELVAIEYENRKTTTTNNKIRNDRVRNRADAFGEKESEFVADRHMILAEFLKIWETQKSLGGQLAEQLTDEVKKEIYNLQKTNTWRCQGVLFSQRKAYWNLGTLGRCDLEPTDMKCPKADMYAQEFLVLTSVNTIRITPPMEASRKLDDKERPKVINAVRKQKTASESTIRKALGIDKGAEKTHYTLNTDGDKFTVNGDWFYSQIVCGAIGEDIWATFDDKKKESANKAILKFDPNEESDESKIRTGCKKWWGLDGKQVEDFISAWKKRPKKSERVNLSRKAIKNLLPYLRDGWSVTEARNMFAEDASNGADDLTRRRYSTKEVVVDKRIRHFQEKHPNILPPVSEGISNPVVRKSIHEVRKHLMEYIKQNGRPDRVVIELAREARQTEKVIAKEIQKNKAIKALKDGIIETHNLKALGITITQRERAIQRVRLCRQQREMCAYSGITITDVMAADGSGLEIDHIVPRSKGGNNGMNNLVLCFSTANQGKGNRTPIDWLSKEDFRKLELRFKHLQKSKKGKKEESKKSQRVITKDNVDMVDNAKWENLHRKTPKEGFTEEQLRSTAYAATQTSDWINKVLYGSEDRGKRYVFASRGDYTGILRRDWGLFFDEDGERSEKGRKNRGDHRHHAVDAAIIAMTTQCLPKIKQSFIDFEKQKENKRIEPDWKTVEQPWEGFSEQLAEEYKKLKVSHRAYNKQIAGYLHKDTIYGPAVIYEKHKKDDEKKGIKKGDVKINEDGNPILKEGMYIKSIPAAGIKQNHLRMPDGWDKLKEEYKYLTTKPEKKAIRKKMLSLEDVPPAKSGVIRDIELRDKIRDWLRVHNFADMGKAKAYIKENGLIINGTPVRKVRVLWKLNEVVEIPRKSFNFETGKIVKDNNYKSLRVYQTQNNHHIEIRENNKGKWVGEVITNFDAAKRVRTDKKPIVDKNENKNGKFVMSLARGEVVHMKHPDTQEANYFVVFKIDPSKSIHFTKHTDANPASKGVKLREDVPLVPDKLRQNIIFDKDCVPEKVKISPLGEVKVLVKN

SEQ ID NO: 7573 - protein, 1200 aa, unidentified
  REGION 1..1200: note = Description of Unknown:uncultivated organism sequence
MKLLGIDIGSNSVGSAWVDTDKKLIEMGVSVFPAGVEESETKRGAPKNQARRSQRQQRRSIERRAKLKMRLRKYLLEKNWIPTEKEKLQEWESSHKFNPWLLRKKALHAELDPYEFGRILLHFAQRRGAWWFDEEPEETENGKKKKKDPAETLGTVEYTKAVMKKKGAETFGELIAIEYENRKTVTANNKMRSNRVRNRANAFGEKVSEFVADRHMILAEFLKIWEAQKSFGGKLAKQLTDEVKKEIYNPQKTNTWRCQGVLFSQRKAYWDLGTLGRCDLEPTDEKCPKADMYAQEFLVLTSVNNIRITPPAEPIRKLNDEERSKVVKAVRKQQTASEGTIRKALGIDKGANKTLYTLNTDGDKFTVNGNWFYSQIVFGVFVEDEWSAFDLNMKESVNRAILKYDPNEEDDENKARTGCKKWWDLTDEQTENFISAWEKRPKKDQRVNLSRRAIKNLLPYLRDGWSVTEARNMYAEDASNRADDLTRKRYSTKEVVVNKQIRYFQQKHPGILPPVSDGISNPVVRKSIHEVRRHLMEYTRKYGRPDRVIIELARKARQSEKVIAKKMQKNKAVDSLKKEIIETHNLDAPGITSTQREAAVQRVRLCRQQRKMCAYSGVTITDKTAADGSGLEIDHIVPRGKGGDNSFSNLVLCFSTANQGKGNRTPIDWLSEDKFGNVEKIFKHLHPQKSEKGGRFITKDNVDMIDEAKWKNLHRRTPKEGFTEEQLRSAAYAATQTTDWINKVLYGSEDRVKRYVFASNGEYTGILRRDWGLFFDENGERSEKGVKLRGDHRHHAVDAVVIAMTTQFLPKIKESFIDFEKQEENKNIKPQWKTIEQPWEGFSEQLEEKYKNLKVSHRAYNRRIAGHLHKDTIYGPAIIYDRHKKDDEKKGIKKGDVRIDKDGNPVLKKGMYIKSIAAIGIKQNHLRMPDGWDKLKEEYKNAATKPQRKAIRKRMLALENVPPAKSGIIRDIELRDKIRDWLKEHNFEDMGQAKAYIKENGLIINGTPIRKVRVLWKLNEVIEINRKGFDYKNSPQEKLRKSLRSYQTQNNHHIEVRENEKGKWIGEVITNFDAAKRVRVKQPKQKPQGWTPPPAVNREDTKKGRFVMSLSRGEVVHMRHPETQKAGYFVVFKIDPSKSIHFTPHTDANPASSKKKGIKLREDIPLVPDALRQSIIFNENGVPEKVKISPLGDVKLLVRD

SEQ ID NO: 7574 - protein, 1200 aa, unidentified
  REGION 1..1200: note = Description of Unknown:uncultivated organism sequence
MKLLGIDIGSNSVGSAWVDTDKKLIEMGVSVFPAGVEESETKRGAPKNQARRSQRQQRRSIERRAKLKMRLRKYLLEKNWIPTEKEKLQEWESSHKFNPWLLRKKALHAELDPYEFGRILLHFAQRRGAWWFDEEPEETENDKKKKKDPAETPGTVEYTKAVMKKKGAETFGELIAIEYENRKTVTANNKMRSNRVRNRANAFGEKVSEFVADRHMILAEFLKIWEAQKSFGGKLAKQLTDEVKKEIYNPQKTNTWRCQGVLFSQRKAYWDLGTLGRCDLEPTDEKCPKADMYAQEFLVLTSVNNIRITPPAEPIRKLNDEERSKVVKAVRKQQTASEGTIRKALGIDKGANKTLYTLNTDGDKFTVNGNWFYSQIVFGVFVEDEWSAFDLNMKESVNRAILKYDPNEEDDENKARTGCKKWWDLTDEQTENFISAWEKRPKKDQRVNLSRRAIKNLLPYLRDGWSVTEARNMYAEDASNGADDLTRKRYSTKEVVVNKQIRYFQQKHPGILPPVSDGISNPVVRKSIHEVRRHLMEYTRKYGRPDRVIIELARKARQSEKVIAKKMQKNKAVDSLKKEIIETHNLDAPGITSTQREAAVQRVRLCRQQRKMCAYSGVTITDKTAADGSGLEIDHIVPRGKGGDNSFSNLVLCFSTANQGKGNRTPIDWLSEDKFGNVEKIFKHLHPQKSEKGGRFITKDNVDMIDEAKWKNLHRRTPKEGFTEEQLHSTAYAATQTTDWINKVLYGSEDRVKRYVFASNGEYTGILRRDWGLFFDENGERSEKGVKLRGDHRHHAVDAVVIAMTTQFLPKIKESFIDFEKQEENKNIKPQWKTIEQPWEGFSEQLEEKYKNLKVSHRAYNRRIAGHLHKDTIYGPAIIYDRHKKDDEKKGIKKGDVRIDKDGNPVLKKGMYIKSIAAIGIKQNHLRMPDGWDKLKEEYKNAATKPQRKAIRKRMLALENVPPAKSGIIRDIELRDKIRDWLKEHNFEDMGQAKAYIKENGLIINGTPIRKVRVLWKLNEVIEINRKGFDYKNSPQEKLRKSLRSYQTQNNHHIEVRENEKGKWIGEVITNFDAAKRVRVKQPKQKPQGWTPPPAVNREDTKKGRFVMSLSRGEVVHMRHPETQKAGYFVVFKIDPSKSIHFTPHTDANPASSKKKGIKLREDIPLVPDALRQSIIFNENGVPEKVKISPLGDVKLLVRD

SEQ ID NO: 7575 - protein, 1200 aa, unidentified
  REGION 1..1200: note = Description of Unknown:uncultivated organism sequence
MKLLGIDIGSNSVGSAWVDTDKKLIEMGVSVFPAGVEESETKRGAPKNQARRSQRQQRRSIERRAKLKMRLRKYLLEKNWIPTEKEKLQEWESSHKFNPWLLRKKALHAELDPYEFGRILLHFAQRRGAWWFDEEPEETENDKKKKKDPAETPGTVEYTKAVMKKKGAETFGELIAIEYENRKTVTANNKMRSNRVRNRANAFGEKVSEFVADRHMILAEFLKIWEAQKSFGGKLAKQLTDEVKKEIYNPQKTNTWRCQGVLFSQRKAYWDLGTLGRCDLEPTDEKCPKADMYAQEFLVLTSVNNIRITPPAEPIRKLNDEERSKVVKAVRKQQTASEGTIRKALGIDKGANKTLYTLNTDGDKFTVNGNWFYSQIVFGVFVEDEWSAFDLNMKESVNRAILKYDPNEEDDENKARTGCKKWWDLTDEQTENFISAWEKRPKKDQRVNLSRRAIKNLLPYLRDGWSVTEARNMYAEDASNRADDLTRKRYSTKEVVVNKQIRYFQQKHPGILPPVSDGISNPVVRKSIHEVRRHLMEYTRKYGRPDRVIIELARKARQSEKVIAKKMQKNKAVDSLKKEIIETHNLDAPGITSTQREAAVQRVRLCRQQRKMCAYSGVTITDKTAADGSGLEIDHIVPRGKGGDNSFSNLVLCFSTANQGKGNRTPIDWLSEDKFGNVEKIFKHLHPQKSEKGGRFITKDNVDMIDEAKWKNLHRRTPKEGFTEEQLHSTAYAATQTTDWINKVLYGSEDRVKRYVFASNGEYTGILRRDWGLFFDENGERSEKGVKLRGDHRHHAVDAVVIAMTTQFLPKIKESFIDFEKQEENKNIKPQWKTIEQPWEGFSEQLEEKYKNLKVSHRAYNRRIAGHLHKDTIYGPAIIYDRHKKDDEKKGIKKGDVRIDKDGNPVLKKGMYIKSIAAIGIKQNHLRMPDGWDKLKEEYKNAATKPQRKAIRKRMLALENVPPAKSGIIRDIELRDKIRDWLKEHNFEDMGQAKAYIKENGLIINGTPIRKVRVLWKLNEVIEINRKGFDYKNSPQEKLRKSLRSYQTQNNHHIEVRENEKGKWIGEVITNFDAAKRVRVKQPKQKPQGWTPPPAVNREDTKKGRFVMSLSRGEVVHMRHPETQKAGYFVVFKIDPSKSIHFTPHTDANPASSKKKGIKLREDIPLVPDALRQSIIFNENGVPEKVKISPLGDVKLLVRD

SEQ ID NO: 7576 - protein, 1199 aa, unidentified
  REGION 1..1199: note = Description of Unknown:uncultivated organism sequence
MKTLGIDIGTNSVGSTWIDTDKKIIKMGVSVFPAGVEESEGKRGAPKNQARRTQRQQRRSIERRAKLKIRLREYLLEKKWIPTEKEKLQKWENLNPWLLRRDAVREELKKDDNFSAGEKFGRILLHIAQRRGAWWFDEEPEETENGKKKEKKDQAEIPGTIEYTKKVMKERGAETFGELIAIEYENRKRNTANKKLRNDRVRNRANALGEKESEFVADRHMILAEFLRIWEIQKKFVGKLAKQLTKEVKEEIYNKKKTNTLRCQGVLFGQRKTYWDLGTLGRCDLEPTAEKCPKADMYAQEFLVHTSVNNIRITTPAESIRKLNNEERSKVVKAVRKQQTASEGTIRKALGIDRGANKTLYTLNTDGDKFTVNGDWFYSQIVCDAFGEDVWASFDNKIKNAVNGAILKFDPNEEDDKAKISAGCKKWWNLTDEQTEKFISAWRKRPKKDQRVNLSRKAVKNLLPHLRDGWSVTEARNMYAEDASNGADDLTRKRYSTKEIFINKQIRHFQQKHPGMLPPVSEGISNPVVRKSIHEVRRQMTEYIRQYGKPDRVVIELARRARQSERVIAKKIKKNKAIDALKKEIIETHNLKAQGITSTQREAAIQRVRLCKQQREMCAYSDATITDAMAVDGSGLEVDHIVPRSKGGDNSMSNKVLCYATANQGKGDRTPIDWLKKEEFRHLELRFKHLAGSKKDKYAITKDNVDMVDNAKWKNLHRKTPKEGFTEEQLRSNAYAATQTADWINKVLFGSEDKNKRYVFASNGDYTGILRRDWGLFFNEDGERSEKGRKLRGDHRHHAVDAAVIAMTIQCLPKIKESFIDFEEQKENKKIKPDWKTIEHPWEGFSEQIAEEYKKLKVSHRAYNRKITGHLHKDSIYGPAVIYERHQKDDAKNGIKKGDIKIDKDRNPVLKEGMYIKSIPAIGIKKNHLRMPNDWDKLKDEYKAATTKSLRKAIRKKMLAIEDVSPAKPGIIRDVELRDKIRDWLKEHNFSDMEKAKAYIKENGLIINGTPVRKVRVLWKLNEVKEIPRKKYDFESGSIMKDNNYKSLRVYQTQNNHHIEMREKVNKKGEVKWSGEVITNFDAARRVRAEKKPIIDRNENKNGKFVMSLARGEMVHMRHPDTKEANYFVVFKIDSSKAIHFTAHTDANPASSKQKGVKLREDIPLVPDMLRQHIIFSENGTPEKVRISPLGEVKVLISD

SEQ ID NO: 7577 - protein, 1195 aa, unidentified
  REGION 1..1195: note = Description of Unknown:uncultivated organism sequence
MAGYTLGLDIGSNSVGSAAVDIENRVIRMGVSVFPAGVEEREDKRGAPKNQDRRSKRQQRRSIERRAKLKRRLRQYLLEKGWMPKEKDELRKWESSPIFNPWLLREKALHEELNQYEFSRILLHLAQRRGAWWFDEEPEETEKSKKPKKDPAEIPGTVEYTKRIMSQKVAETFGELMAIEYRNRITKTANNRIRNERVRNKNNAFGEKESEFVADRHMILAEFSKTWEAQKAFGGHLAKQLTDEVKKEIYNPQKTDTWRCQGVLFSQRKTYWDTGTLGRCDLEPTDEKCPKAGMYAQEFLVLTSVNNIRITPPMRESRKLDDNERKKVVDVIRKQITASEATIRKALGIDKGANKTLYTLNTDGDKFAVNGDWFYSQIACGVFGEDKWLLFDDKKKGSVNNATLKFDPNEEINECKIREGCKKWWGLDDEKTESFIAAWKKRQKTSERVNLSRKAIKNLLPYLREGWTVTEARDMYAEDASSDADDLTRRRYSTKEVVVNKKIRQFLEKHPDLLPPVSDEISNPVVRKSIHEVRRHLLEHIRQFGVPDRVVIELAREARQTKKVIDRRIMKNKAIDSLKKEIIEIHNLNAPEITKTQKEAAIKRIRLCRQQREMCAYSGTTITDKMAADGDGLEIDHIVPRSKGGDNSMSNIVLCYSISNQGKGHRTPIDWLSEEQFGKVEKIFKHLHREKGEKGKGAITKDNVDMVDEAKWKNLHRRTPKEGFTEEQLRSAAYAAKQTADWINKVLYGDENRGKRYVFASNGDYTGILRRDWGLFFDEDGQRSEKGRKNRGDHRHHTVDAAIIAMTPQCLPKIKQSFIDFEEQKENKRIKPEWKTIEQPWEGFGEQIAEEYKKLKISHRAYNKQIAGYLHKNTIYGPAVIYERYKKDDGKKGIKKGDVKIGKDGKPVLKEGMYIKSIPAIGIKQNHLRMPIGWDELKNDYSNATEQERKAIRGKMFSLEDVPPGRSGVIRDIELRDKIRDWIKDHEFSNMVKAKEFLKENGLIINGTPVRKVRLLWKLNEVVEIARKGFDYKNSSPERIRKSLRVYQTQNNHHIEIREKTGKKGNVKWSGEVITNFKAAKRARIDKTAIVDKNENKNGKFVMSLSKGEIVHMKLPEKKGADYYVVFKIDPSKTVHFTPHTDANPASSKKKGVKLREDIALVPNDLRQNIIFNENNVPEKVKISPLGEVRVLVND

SEQ ID NO: 7578 - protein, 970 aa, unidentified
  REGION 1..970: note = Description of Unknown:uncultivated organism sequence
MRVLGLDIGTASVGWAVIDEADGDESGSLVALGSRVFPAGAAIKGSSMVTKAAERRQKRAMRRQHRRRSHRKALLRAALAGKGLAPDDPAGLEAWLQLDVEGLWSIDADGGELTLQEVGRLVYWLSTRRGFLSLRSGGGAEADEDEGESFVPKRLRSDQESALLGLWAQQAEHHPSVLTDELLFGSLGRQVYPVKPEALNHDGAHPPTPFEVVERFGVHGIVFFQRAIYWRESTVGHCPLMQRHTRAPRGDRAAQDYALRLTLINLRVGDDRRPLTQDEVDRLTDRLRWAKTMTFKALRRELGLDADAFVSLDRGRKDGKLLGHQTDATLGMPSALGEVYRDLTDEDKDRVVQLLMSSAPEQVRIPQLRALGLDDVGIDAALNAAAKRWPTGRAAYSRAAMRRLLPYMVAGSTEARARTRAFGKTTHERSVAEPTSPLVKTAVAEALRVTRAVERDYGPIDVVRVETARDVRQNAARRRETETRQRDFEAERARAAKWLEENDHPVNRSNIERVRLWRAQGEVCLYSGRPISAGQLFTACEVDHIAPRSLSLDNSFANKAVVFTQENRDKGGRTVGEWLSGQPDKMLEIQQRAKSMRLSFRTRQKLGEWAPNQDDQAAALLAQTGYITTWVQGRLRTVLPEARIEPTNGRLTAQARHLIGLSKPERDYRRHALDAAMVAITDAALARRLRALYRSKENHRSSDAVTVEPWEGFRGDVLKALEDVVVSHRVNRRVRGSLHEETLYGEVTSPERRDKKGQPVAVAARRRPVEMLNAKQVSEVADPAVRKALYDHLSDRGIDLTSKTLFKADDPPLMPPDSNGDRIPIRRVRTHISVGSGVPLSQSRNRTLVVPGNNVLAAVYRLESGSLSISVASLWRVCTSGHPSPPNHATELLFTLAPGDVFQTVDDGGVPEYWRVTDLDGANRRLGATLHWVDGREKGARQVFTAKRLKDACASKVVVSPSGLVRTARD

SEQ ID NO: 7579 - protein, 1365 aa, unidentified
  REGION 1..1365: note = Description of Unknown:uncultivated organism sequence
MPAYLGLDIGSNSVGSAWIDTDEKTITCGISVFPAGVDESDYKRGEPKNVKRRMARRTRITLARRAARKRLLRQKLLAVGLLPRDEGDFKRLLETTDPWELRSKGLDHELTPHEFGRVLLHLAQRRGALGLKLPDAEDGQVDTTDDEGRVKAAIGHVRAQMLERKARTFGEFIAKVRAERVSPITTEDRRPPARRKGPREYRDPIRNRAGSYEHCADRAMIRDEFTKLWEAQTAFNGETARLLTQANGLRTALDDEAGDSIWLHKGLLFGQRRQSWDLGTLGRCVLEPTERCVPHADMYASRYLVVETVNNLKIIERGREARPLTPEERQKIKDYLSGPLGTERARKKRGDTGPVADKPKTSVTITDVRNLMGWGRATRTSQFRFNIESDPDRVINTGWFSREIIHGAITPAKWAEMPQRLRDGINRAILKYDPDHEGAADKLTLGVMQWGGLNETQADALVAAWKRRPRPDAKRLNMSRRAVRNLLALMDRDEPWPNPRQPGQTCWLTQIEARKLIAEDADFKDVTTGAPLDLQTRVRYATGAKGATARDRYYMQKHLLLKNGKPIFGPDGLPLAEPPPAPLITNPVVRKAIHEVRRHLVDYMLRFERKPDAIVVELAREARMGKVDADRVLFRTRLRNRIRNDIIASFGLGALTSTQQRAAVARVVLCVQQGGICPLCGNQIVTTQITPRMAASGEGCEVAHIIPKACGGDNGLGNIVLAHTKCNRDMGRRTPRQFWEGTFQGGFEEGMRYVEGIYRDIERPKLSEVRSATGQSLWACYFSGRPGRFGPTFDELKIEQFTKSVTDIQEMTPRQEAATKYATRQVMTYLANALYGGQGLPERSGQRRIFATDGLWTSHLRREWRLFFDPHASRTNGLSEEQEHVRKEKDRGDHRHHAIDAVVIALTSPRVQNAWEQRERMADRDGVNTADEVALENYRRAHPLPPPVPFANAQELKQLVHAAVFGSDSLERPVCHRPVKRKLIGELHEAFPRGPVLDRAGSLTDRFTRRISILELDPNHLREPRPETKNEAIKRLAERRRRQTGEDESAARKWARAVVSASGYMPAIVDQPPGKSGIVRDLALRRRLRDCLSAEGLDPDNFTANQIKKLAEAGKVRHVSGVPIRSVVLLWTISDPVLASRWATDHGTGKRRMLFDAVTHQGDARAARAYIGGNNHHIEFRVAPQPDGTEIWSGKIVTAFEVARRKSQRLRAFRQAGIPKPGDFRKLPKSQRAQFKPTLRAIEAAYPLVDRSNDDAKGGEFVMSLAEGEMLMMKHKVTGKLGYFVVAKLEKRGGNNRDCAVLVPHWDARAAGERKDAEGKRVPDSKREQFTITPVDLKLLAPPDHPHAIKVRATPLGDVYPLQRD

SEQ ID NO: 7580 - protein, 1365 aa, unidentified
  REGION 1..1365: note = Description of Unknown:uncultivated organism sequence
MPAYLGLDIGSNSVGSAWIDTDEKTITCGISVFPAGVDESDYKRGEPKNVKRRMARRTRITLARRAARKRLLRQKLLAVGLLPRDEGDFKRLLETTDPWELRSKGLDHELTPHEFGRVLLHLAQRRGALGLKLPDAEDGQVDTTDDEGRVKAAIGHVRAQMLERKARTFGEFIAKVRAERVSPITTEDRRPPARRKGPREYRDPIRNRAGSYEHCADRAMIRDEFTKLWEAQTAFNGETARLLTQANGLRTALDDEAGDSIWLHKGLLFGQRRQSWDLGTLGRCVLEPTERCVPHADMYASRYLVVETVNNLKIIERGREARPLTPEERQKIKDYLSGPLGTERAPKKRGDTGPVADKPKTSVTITDVRNLMGWGRATRTSQFRFNIESDPDRVINTGWFSREIIHGAITPAKWAEMPQRLRDGINRAILKYDPDHEGAADKLTLGVMQWGGLNETQADALVAAWKRRPRPDAKRLNMSRRAVRNLLALMDRDEPWPNPRQPGQTCWLTQIEARKLIAEDADFKDVTTGAPLDLQTRVRYATGAKGATARDRYYMQKHLLLKNGKPIFGPDGLPLAEPPPAPLITNPVVRKAIHEVRRHLVDYMLRFERKPDAIVVELAREARMGKVDADRVLFRTRLRNRIRNDIIASFGLGALTSTQQRAAVARVVLCVQQGGICPLCGNQIVTTQITPRMAASGEGCEVAHIIPKACGGDNGLGNIVLAHTKCNRDMGRRTPRQFWEGTFQGGFEEGMRYVEGIYRDIERPKLSEVRSATGQSLWACYFSGRPGRFGPTFDELKIEQFTKSVTDIQEMTPRQEAATKYATRQVMTYLANALYGGQGLPERSGQRRIFATDGLWTSHLRREWRLFFDPHASRTNGLSEEQEHVRKEKDRGDHRHHAIDAVVIALTSPRVQNAWEQRERMADRDGVNTADEVALENYRRAHPLPPPVPFANAQELKQLVHAAVFGSDSLERPVCHRPVKRKLIGELHEAFPRGPVLDRAGSLTDRFTRRISILELDPNHLREPRPETKNEAIKRLAERRRRQTGEDESAARKWARAVVSASGYMPAIVDQPPGKSGIVRDLALRRRLRDCLSAEGLDPDNFTANQIKKLAEAGKVRHVSGVPIRSVVLLWTISDPVLASRWATDHGTGKRRMLFDAVTHQGDARAARAYIGGNNHHIEFRVAPQPDGTEIWSGKIVTAFEVARRKSQRLRAFRQAGIPKPGDFRKLPKSQRAQFKPTLRAIEAAYPLVDRSNDDAKGGEFVMSLAEGEMLMMKHKVTGKLGYFVVAKLEKRGGNNRDCAVLVPHWDARAAGERKDAEGKRVPDSKREQFTITPVDLKLLAPPDHPHAIKVRATPLGDVYPLQRD

SEQ ID NO: 7581 - protein, 1258 aa, unidentified
  REGION 1..1258: note = Description of Unknown:uncultivated organism sequence
MICLGLDIGSNSVGSAWVDTEKREVHLAVSVFPAGVDEQEDKRGAPKNQARRQKRSQRRTLARRSARKRHLRSFLTQAGLLPTDPADLEMLFQANPWYLRREALSRPLTPHEFGRIVVHLSQRRGAVGITTDPDDPNEGKVKDGMDRLDKLMRDRGPDTTIGQLMADLIDERRQEHDGITWNEPIRNRQYRIPEDQQLFAGRELIRREFHRIVEIQRSFKDSQLGPMLTDDVIRSLDDPTQTDTWRHQGLLFGQRRTYWDTGTLGRCVLEPTERCAPIADRHASYFRVVETVNSILIERQGQPKRPLTPEERDKVVRLLRGPLFKKSRGRPEPKSTASVTDIKEALGIKPRDKTVKLNIEADEDREINTDWFHREIVHGAFTEAKWELLAEDQRESVNRAVLKFDPDQADDAARLRAGAERWWAMDAASADRLVEAWKRRPRLEKRLNLSRRAILNLLPIMNRFDSVNNRWPTQQEARKLYARTLNDQHARRRYETGAPGLSAADRYYMRLGKHQIVAGVPELPPAPTLSNPVVRKAIHEVRRHLVAYLRRFGRKPDRVVIEMARVTKQSERQRNEALARNRHRDKIRKAIIKEILPAAFGEEEAARLSLSQQRAAVDRVVLARQQRNVCPYCGQGGLTDLLAARGDDLEIDHIVPYSRCGDNGLNNKVLVHRACNRGKTNQTPREWWGSAFDERIRFAEKVFKDIKPEKSDYFNKRDSDRKWENFTREVREGEEWKNSQLTDTAYAARQVAAYLADALYDGRGLPERGDGEGAQKVFFTMGRFTAMLRKDWQLFETLKPPQRDSKHGELTAEEELRLAEKNRGDHRQHAIDAVTIALTDPTIKNTLASWAAQAAEYYEQHRQWPRRKPTDPPWGDVPSFRKQILSRVYESFDSSELASGKRDERGAASVLIVSHRPVKRRLVGALHEDTHYGPVVGPLPSHRTERIDTLFTNRISVDRLSPNHLRVPEGWDELSVRLDEAGVADARKRDLRKQLSAMKDPSPEKSGIVRDRALRDRIRKCLRANGLDPDGFTANQIKQLVREGKLTMASGVPIKSVVLLRTNSDPVIIPRKQCDPASGKTVPHMDPDNPGAPHPRTRRVYIGGNNHHVEIRERIRQRGGQAVAEWIGEVVTTMDAARRLHPPRNPDGTRPEPRPAVDRSDNHDGVFVMSLAEGETIYARRKDRPEEPASYFVVCKLDKAGNSCRIHFAPHWDARKASEQDRWAVTPGDLRLCGPEPDRPPYKVQVGPLGDVKRLEKD

SEQ ID NO: 7582 - protein, 1225 aa, unidentified
  REGION 1..1225: note = Description of Unknown:uncultivated organism sequence
MSQGAEQVRFILGLDIGSNSVGSAWVDTDKQEVHLAASVFPAGVDEQENKRGAPKNQARRQTRAQRRTIDRRAKRKRVLTRFLMEEGFLPCEPVGLQKLFDLDPWALRRKALKEPLTPHEFGRIVIHLAQRRGAVGVVSDPENPDEGKVKEGMDRMNALLAERGAATVGQLLADLMDERRQQQDGVTWNEPIRNRQYRLPEAQQLFAGRDLIRKEFQRIVEAQRAFEGSGLSGLLTDELVKRLDDPTRTDTWRQGGLLFGQRRTYWDTGTLGRCVLEPTERCVPEADMYAQEFRVVEYVNNLRVRAPFEDWRSLTAQERDQVIAKLRAPLLKRSKGQLVPKKSASMDDIREALGVPKTRRKGADPFEIRQESQDPDRPPNTDWFYREVVHQVFSEPVWTAMEQGARDIVNKALLKLDPDQPDDAERVRFRATGWWGLDDKAAARLVEVWKSRPKLERRLKLSRRAIRNLLPYMNRFSQARRRWPTQIEARQAFAEDRASDASPEQRRRYLIGAPTLTKADRRFLRKHPDLLPPAPMMSNPVVRKAIHEVRRVLIAWRRRMGCWPDQVVLEYTRSATQPEKVRNEQLALNRKRDRIKDGLREQFNLRGLAINQQERAIQRVVLCRQQRGLCAYTGTPISEKTAAEGTDVEIDHIVPRSRSQDNGLNNKVLVLRTANRGKGNQTVKEWLPAEAFAALEQRLQHFQKGEPVEEYSTGRDYARKWENLHRDAPSTGEFLSSQFTDTAYATRQVGQWIRDALYDGERDGRRHVFTTKGPYTAILRKDWGLLEDLLDQHWRLHAVGDADEAAPAAESKARREKGKDRSVHLHHAIDAVAIALAPRKLQELAARAEAEERARALEGRWPRSVPLAPPWPSLPHEASRDDLQQAIQTFRDQVVGAAQQIVVCHRPVKRRLVDKFHEETHYGPVIAPLPCHRTEKADSLFTNRISADRLTPNHLRVPDEWDELSARLDDPGVLPGDKKALRRQLAALVDPSPGKSGIVRDRALRDRIRKCLRGNALDPDSFTAAEIKKLVGEGKLTMGSGVPIKGVVLLRTNADPVIIPRKRWDPTTNRMIRDDDPRTARVYIGGNNHHMEIRQNRRRGRWSGVIIPTFEAARRVRLERRDAVERVDNDDSDFVMSLAEGEMIYARRKDRPPDDPAAVGYFVVCKLDKPARIHFAPHWDARKASEQDRWDVTPGDLKNCGPEPGVPAYKVRVSPLGEVRRLEHD

SEQ ID NO: 7583 - protein, 1104 aa, unidentified
  REGION 1..1104: note = Description of Unknown:uncultivated organism sequence
MTDYILGLDLGPNSIGWALVAVKASGDDLKPVGLLDTTGTGHPAMGVRVFEAGLQNFNTGKEASLNQARRQARAARKTISRRRARKAACLEVLQSADLLPESEQDLAQVWKMDPYKLRADALDRKLDPQELGRALFHLAQRRGFKSNRLSGDEKEEKGLLLEISKLDSEIQRSGARTLGEYLHKQRGHASGTLPTRLRARQARLDLYEDAPRRTRRSMYEAEVEAILTAQERLAGKAALTTEQRAGLHKALFFQHPFALTPGRIKKAPSRANLHRAPGIRPCPYEKGEVGCPKSDWLAQRFRTLKEVQSLRISELHRRERPLTPEEVAYTVDHLSSNKKSSFAKLGKDLARQFNLAEPISFNLARGGRADIKGNELEATLAGAFGKKAWRDKDESERQRLRIAMVKSTSADDLGRILQTAGLADEAKREKLTKWRPRDEGYLSFSKQALKRLLPLMETGMLEHEAIAEAYPDSFEAHGLASLPSLVAMQLDSAIRQKIPPQIQNELTNLTNPVVRRALVEVRKVVNALIRDHGRPIRIVVEMAREMKQGKDARKEHSARLNDRQKRREVARHELKALRSEGWPSRSDVNRWILWEEQNHNCPYCGTGIASAQVANADVEVDHILPRWRSLDDSMNNKVLACANCNADKGNRTPVEWLGKDSERLATILKRTWSCVAKKDNPGGMPFGKIKRFEAEELDADHFAQSQLNDTRYISKLVSSYMLLLYPTNEHVGQKRVQTSKGNLTAHLRRMWGLNRVIPPLVQAHGEIVPGFIEHNGWNEKIRIDHRHHAVDALVVALSTRSFVKRLQDCWRKDDDPKERTSSFEAPWESLRDDAINAIQKINVSHRPMRRKRGGLHEETYYGAVDPASGVYVTRKRLEDLTGPMIKSIRDQRVRQVVTERLLQSGWDGKASKLPKDWHREELFLPTTKPRKGRQPRTPHPIRRVRIEVQLGRTVRLGDKNHRFAKPGSNYCLQVIDTIEGPHPQFRVVTRFDANQPGDWMSLPLGASLIGTLHRKDSVLISVPGLDEPVLCVIQLISGSSEVGTKGLSIVIRDARDSRPATEGNKKPLARLRSHGAWNGAAVRSVEVSPLGVLASDQTALVASP

SEQ ID NO: 7584 - protein, 1061 aa, unidentified
  REGION 1..1061: note = Description of Unknown:uncultivated organism sequence
MTDDNTTHKRRYPGGHRVMPAGAVPARLALVMASTQARISYNTGIVGGQCGAVKRKVEIFLRSSTMAEYTLGLDIGAKSVGWAVVENGTRARIVAMGVRVFPEGVDREKSGLEKSKGASRREARGARRTRRRRTLRRTALIAALRGAGLAPADDGELAGLLSEVDPYPLRAKGLDEPLTPHEFGRVLYHINQRRGFKSNSKSAKQKEDGEIAKQAGLLQAAIEAAGCRTVGEYFARTNPEENRIRGHYTFRSMYEREFDLLWAKQAVYHPDVLTDHLCQQIRDRVIFFQRPLKPTDALIGECGLEPGEKRCAKAAWCARRFRMLQDVNNLRIHNPDGREVCLSDGEREIVLREMQQKAKVTFSSIRKKLNLLETQEFNAEYEVDEKGGRREALAGDAFSATMRSKKVFGNKAWDAMDEARKVRLNEAFVELEDDELVEVLAGEYGLSAEQMEAAMKVPLERGYMSFSRKAIEKLLPLMEAGKRTDEALDAVYPGRNQRAEGVGVERLPMPEDLRNPIVNRALVEVRKVVNAIAREYGKPKRIRVEMARDVKGSAKERREKHYKMLDNERRNAEVREKLRQDIGIARPTRDDVIKYKLWEECGHTCPYTGKHISQTALFGPNPDFQVEHILPYSRSLDDSYMNKTLCEVRENRVKANRTPWEAYGGDEQRFEQILQRVKTLPWPKRQKFQANELEGLDACIQRELNDTRYISREVVRYLKMLGVIVTGTRGSVTAELRHQWGLNTILDPTGSGEKNRADHRHHAIDAVVTAVTSNEHLRRLAESKYGNRGDGFAPPWEEFREEVEENVRQINVSHRVRRKVSGELHEKTFYGPTSETGIYVYRKDLTALTPAMVAKIVDPVVREIVEERLRACKIDGQRDKKIPKEVWNEPLYMRTTKSDKKVLIKKVRIRDVFGKTIPFRDGSGSVYKTAKPGSNHHVEIFEYTNETDKSGRPRRDAVVVSLFDAVQRSKRGEPVVCRDHGPGTRFVCSLAINEMVLMDNGSGEMDLYRVQKMDVSKTVYFRQHTAATLEDEGTLIRKAAHVFEGYKVVVDPLGRVYRAND

SEQ ID NO: 7585 - protein, 1239 aa, unidentified
  REGION 1..1239: note = Description of Unknown:uncultivated organism sequence
MREADIKPLARIPGRYRDAEQIAAIQHAIGKRRHSTRFANLGPFTGYRIGLDIGNGNIGWCILFEQDRLLQFLTAEDIAANNAKLPKGVTRTQLPNLADFVPLGTHKFQARKPGEKIEKSFSKIRAEVRAKERMLDARQRRRLHVRKAISEAGLLPENGICDGIGHEKCHSRISADKLRVKLLNPSFDASAHDLGRALYNLLKRRGWLKPIGRAGEDEGSTFGDKATQYYREALKAFGCETIGAFLDRCAQDAKRDGVHGFRKRHRSLAWQRENQKKQPKDLTKAKSYEVLQFLTPTFELVWEEALLLRARQQRTVPIRDDHWAKIEEAAEFRRSLKAKMPGRCRWFPDEFRCVRALPSYQRFRILEQVSHLRDPHNRVLNDASFGSAVALLEQSEKISVTHLAKELGQDRLRLESDEDKGKRTLVGAKTDIALKSVLGQSWMQLSLDERDAWTMRFLRRHVPMNGQEPRPWTSADEEDLRSDTEKLFGPDALTKVDNIASTSFEDNFASISLKAAKILADAYAKRLDHEQRLAALASAGAPEPELPLYERLPYYGAVMPDQTVPAIGFAPPERMCAEEREHGRAPNPDVHVVMNRVRAVINAIIDMMGGILPTTCVVEVARSALSEDEANAHRKRVMAREKFNQAIIQDIARVFEGLGKRLPRGPGLERLIECWKAAIRQGWRDYDGSRIERSMLIDPTVYQLDHVIPAAFGDFRENNLFVSKYNKIKGRKTPWEAFGNKQDFRPALTAFAEFGLSKRIELLEKALDPKRKLPTKKKAYLEERLKNAREELAELSKSETPRPDVLSALERTLTDKLESLLTCDDSAGDNNAEKGPRRPFDSGDQAALFCRFGPRAKAPEKEFAARDTANIGWSTKLTLRYLRHLGAEVEAIKPWAVHALRSMFGINKERGDLRNHAVDAFFIAHFDSRVLRPAFASLRGGPEWLYSTRLLDSALSHIDGGQGFLNGLERNLDCLDKTLPVIATAHRADNMWNPGDPVGGSFGALGGENIYSFRPTREEREKLTAILAGDGKSPVGHILTRTEILELLKSEPQDKKNRRLLKKLRDAVELRYLSREEKGTKRTLLKISTAMPLSDQPGAFIDVQSKFAIMGPTPNEGRLVVNVADFSAMSLAKRTALFRNARVVYRRGDMITSLGSPFVVTGLTADGRLIAYTADVAQRDKQQKHLLTVPSGIEGKDSNPKTSKPILNKLSIDVLGRRLHRLRKTPGGLAPMPYPLREQ

SEQ ID NO: 7586 - protein, 997 aa, unidentified
  REGION 1..997: note = Description of Unknown:uncultivated organism sequence
MSQITLGLDIGSTSIGWGLLKLNDQPSILGAGVRVFQEGVNRDTEGAEVSKNETRRLARGARRNRFRRNYRKDKLLRLMKRNGLFPDGQSVNGDLFLTDPYKLRAKGLDEKLSLYEFGRVLYHLNQRRGFLSNRKTNKGKDDGIVIKSAAELQQRMEAQGARTLGEYFAGLDTSQERIRDNYTFRSMYQKEFDLLWQKQASFYPELLTEQLRQQIADATIFYQRPLKPTAELIGDCSLEPGQKRCPKGDWYARRFRILQDINNMLVCQPDGTERKLTDAEREIALKNLTSSKEVSFDSLRKKIGLLETQTFNLQEGALDKKNAKLQGDFFAATMAKILTKKVWEAMDTATQIEINDLLMSDEFTDEQVVQMLKQQHHFSEEQAQAAIEIGFPRGYMSYSRLAIQKLLPHMERGLRTDEAVKAAYQRIHSIQDNGQTVDILPLPKDLRNPIVNKALIEARKVVNAIVRTYGKPDKIVVEMARDVKGSAKERQELRFKMDENERENKQAEHELIYNIGIARPTRDDIIKYKLWQECGRECPYTGRPISQQALFGQHPEFQVEHIIPYSRCLDDSYMNKTLCHVDENRRKGDKTPYEFYYGAEQYEHILQRIRRLPYPKRQKFSQKEVSLDECIQRQLNDTRYITREILAYLKQLGCTVTGSRGKVTAELRHQWGLDSILNSDLPGLKNREDHRHHAIDAIVTAVTTPKHLRDLAATKYAVHRDGFPAPWEGFRDAVAQAVNRINVSHRVTRKVSGPLHEKTSYGPTGLKDDKGQDIFVYRKPLEALTCPMVEKIVDPVVRELVKARLLDFGIDPEKNATISKEVWKEPLYMKSNSGVKVPIKKVRIRDVFNNMIPIKDASGKPYRYVASGNNHHIEIFEYADAKGNTKRDGKVISMFEAVRRSRQGLPVVCRDYGDGKKFVCSLAKNEMFMLEVEQGCHTLHRIQKLDVNGGIVLRPATFAGQLDNKDKPPYIQRKTPNSLRGYKVTVDPLGRIFPAKD

SEQ ID NO: 7587 - protein, 1035 aa, unidentified
  REGION 1..1035: note = Description of Unknown:uncultivated organism sequence
MNYHNNSNRDTMNTILGLDLGVASIGWSLVEKSEDDGKIIKSGVRIFQSNEQRAEAAPGESSNADRRKKRSVRRQRDRRSRRKAKLYHCLKRNGLAPSKTKWDDWVSINPYTIRASALDKKVSLHEFGRALYHLNQRRGYKSNRKAGNDKKGPVKEGISKVREQINKYDARTIGEYFYEIYDNHLKEEVNHDDFNWRIRDKYTHRKMFKEEFEKLWESQIKYHEVLTDELKNEIKEIIYHQRKMKSQAHLIGKCPLEPDKKRIAKAHLLFQEFRVLKNLNNLTLADENGVYIPFEDEQKNIVKELLDRKDKATWSQLKNSLLKNDAIANKNAIFNLERGGRKRIEGNSTNKALSHSKAFGDDWYEFEDEFKNHVVDVLTHVTKPEKVKELALNRWGRKKEQAEYLSKLTLEKGYANFSEKAIKKLLPYLKEGFEESTAVKKAGYDLFEQKPGKLNQLPMPSQEIKNPVVYHALIELRKVVNGIIREYGMPDVIRVELARDLKAGYEHRQKMNRKMRKLQKKNDKAREALNKAPFNVSHPGYNDIIWYNLWEECDKICPYTGKSIPAEAFNSGEFQIEHIIPFSKSLDNSYANKTLCEADFNRQKGNRTPWECVEAGLIDEDDLLQRIRNLPWNKRNKFTQKEINTSKFINRQLNDTRYISREASSYLKHLTCENIEVVKGQTTALLRHLWGLNSVLNKEDEEMKNRDDHRHHAIDASVVALTNRSTLKRLSDENKRISPAEWMDEDEGSQFTYQEMKRRVGDRIDLSDPWSSFRKDVENSINEITVSHRVDRKISGALHEETYYGPTDEDAPKNKEKMVVRKPVHELTKKELGLIRDDGIRKIVNEEIQQRMDEGKSRNAAVKSLEGDPPYIISTKAKVPIKKVRLLMEKDPEKMHHFENEEGEVYRHALYGNNHHIAIYETTDDKGQKKQVGIVVPMMEAARRVKDGEPIVMKDYRPDHSFLFSLAINNSVMNKEDGEIYRVQKIASGGQITFRSNAVALKGQSDPGVLRKNPSALSMNKIKISPVGEIFPAND

SEQ ID NO: 7588 - protein, 1001 aa, unidentified
  REGION 1..1001: note = Description of Unknown:uncultivated organism sequence
MAEPYLVLGLDPGISSCGFALLDMNNHKILEMGSHLFDAPQESDKKVSLAVKRRNARSARRNNLRTKNRQKHCMELLKEADLVPQDATKQWFQSAKGDRPLLELRFAALERPLTNREFAQVLYALSARRGYIPHGEGRISKISDVDTSGTSDAETGKVLKAIGENNKLMAQGHFRTVGEMLYNQGKSRNKRGSYEHCVLNSQIVDEVRAIFQSQRSYQNPIATQELEDAYIENLTWEKRTLDHDAKVYALVGKCVYFSNDENRAARADLSSELCNAYERLKHLRIVNADGDETALAPEQVEAYIAILFSPEPLKGKKEKVTYARIRRDLDLSARLFFKGIDPEDEKDHEPYAPKAWRTMRKVLSPELMERLRSDRTLADAVGEALTYASTEDSLLYQLDNLDLSDEERNQILGLPFSGKIFKGYGSRSLKALDMLIDAFEEPEVTTLAEAEESSGLLGLRMSDSGTRYPLLPPYSTYDKENRNPVVLRAMGRMRRIVNAIIRIYGVPDEIHVELGRDLKRSKHEKDLINKRDRENERKNKQWRAQIAEAQGIDPDEVRPKLLKKIALWEEQDNFDIYTGHKIEFDRMISDDKYCEIDHVLPYSRTCDDSRNNKVLVLSKSNQDKRERTPYEWMTQDAQKGAPSWDEYQARVIANHHISPRKRRYLLNNNLGPDQERDFLSRNLNDDRYMSRAVKNYLEDSLIFPKDGRVRHVIAVAGGATGSLRHVWGLNFGANNTKDRSDDRHHAVDACVIAACSEATVQAVAKAHKLGVETYKHMREDRLKNTQPWPTFADEVIARREFIIPTRMVSHGVTGQAFKDTNYRFVGLTNDTKKLGVLYYKGKFTKEGNFVIGDDGNARLVDGMAFLRLWLDPTAKKGKGKWYAEPVYYADIPAIKNGTYIPKAGKRGVARIVWEPISQVARNTKPLVLFRGDVISMGGHTVRYWSFSINTLTLRTRDLITGAEYKGFPTINQWSRDSYPKKIQEDCLGHCYKGLVPSSLED

SEQ ID NO: 7589 - protein, 1017 aa, unidentified
  REGION 1..1017: note = Description of Unknown:uncultivated organism sequence
MFIKFHEGASMESERAYLVLGLDPGIASCGFCLLDMTNHKILEMGSRLFKTPQEDKTKVSLAVTRRNARSARRNNERTKSRMKHCMDILADEGLIPEDADKTWFQSKKGDKPILKLRSCGLNRALTDREFAQVLYSLCGHRGYIPHGEGKDAETDDAEGKKVLNAIKRNTEEMTAGGYRTVGEMLHSRGKSRNRGGNYDFCVYNSQIQSEVHAIFEAQRALGNLKANEKFEDRYLECLTWEKKSSDHDKKVYEQVGTCIYFPELKRAADADVSSELCRAYEKLGHLVIVHVDGAEQRLTGEQISHYIGILFSPTPLNNNKYCKVTYSTIRSDLDLSGKSVFKGVPQEKEKDEVFVPKAWRCLRKVLANDHEDLLDRMLNDRELGDAICEALTFSSSETSLQEQLEPLGLAEDECVALSSIPFNGKLFKGYGSRSIKALSILLGAFEEPGVQTLADAEKATGLDRKRLEDRVARSELLPPYNTYDETCRNPVVLRAMGQMRHIVNAIIRIYGVPDEIHIELGRELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNLNDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHGVTGCVFEDFSYSLEGIDEKGYAHISRQTDRTTGECRSLKASNFEIVNETTVKLLDSMAFLRLWHDPHAGKTGRWYIEPVYCADIPNLDGKTYHPRYQKQKVARSGWPLVPAEALKNKPLLLFRGDVLIVGNHIARYWKFDIGGGKATMLSIVDINSEAKGFPSISKWKNDMPVRILSEDCLASCYKHMTIDSENSTFEER

SEQ ID NO: 7590 - protein, 1053 aa, unidentified
  REGION 1..1053: note = Description of Unknown:uncultivated organism sequence
MTNNRSYLVLGLDPGIASCGFCLLNLANHSILEMGVHLFEAPQDPKTKVSFAVGRRNARSARRNNLRTKMRMKHCLELLNEAGLVPPDADRNWFQSRPGDRPVLKLRARGLDTRLNDREFAQVLYVLCRRRGYIPHGEGRLSQTDDAEGRKVLKAIRENTEALKSGKYRTVGEMLNAEGVSRNRGGDYTRCVYNAQIQDEVRTLFCAQRALGNKKASEEFETAYLDCLTWEKPSLDHDEKTYELVGQCSYFPEEKRAANADISSELCRAYERLGHVVILREDGSELTLTKKQINEYLSILFSPCPIKKNKDCKVRYSDIRRDLDLSGNDRFKGIDFDDEKSSEPFAPKSWRCLRSNGVSEELLQRLLGDRALGDAVGEALTFASSERSLLERLSMLDLSEDETKELIGVPFTGKLFKGYGSRSLKALGMLLDAFEEDCVRTLKDAEENSGLLGWRLSDSGNRSTLLPPYDTYDPTCRNPVVLRAMGRMRRIVNSIIRIYGVPDEIHIELGRDLKRSNHEKAIVSRRQKQNAAANKKWSKIAGAILGIAPEEVKGSIIRKLSLREEQGEKDLYTGKAIDLERLVRDDRYCEIDHILPYSRTCDDSRANKVLVLSKSNQDKRERTPYEWMVESGEPDAPDWEEFRARVFATVKDRRKANRLLNDNLDRSSEQELINRNLNDDRYMSIAVKNYLEDSLLFPVNGRKKHVSAVSGGATGNLRWVWGLNFGDHNDKDRSDDRHHAVDAAVIAACSDATVKKVAEARAKGRETFKHLRKSRLSDTQPWPTFAEDVIAKREHVIPTRMVNHGVTGHVFKDTLYHLEGYSEDKGRYPIVRASGKASKKGNVVTYPDGSARLVDGLAFLRLWLDKTAKGPKGSVGKWYAEPVYYADIPAIKNGTYVPRACKIHVARVNWEPVPSCALESEPIVLHRGDVLIVDEHIGRFWTIDINSCGLEIRSISTGEPIGPSFPSTPASWNASTTISVLQEDCLGHCYNQLPLNREDSTFFLLSRRCPVHNGRGTSLESQRHLRTRINSRTMFWPCVHQHLSRFVLFFRQR

SEQ ID NO: 7591 - protein, 1008 aa, unidentified
  REGION 1..1008: note = Description of Unknown:uncultivated organism sequence
MVEVKTEAVGRLGRPRYLVLGMDPGIASCGFALLDVNNHEILEMGVRLFDAPLHPKTKQSLAAIRRGFRSTRRNIDRTQDRLKHCLKCFKKYGVVPDDADKEYLHMVKGDKRPLELRVDGLNRMLTNREWGMVLYSLCKRRGYIPHGEGAQDKSSDDGKVLAAISANEKEIAAGEFKTVGEWLASRPASRNHGGNYEMCVRHEQLIEETRILFEAQRSFGSKVASEDFEREYIDICNWERPRDDFDKRTYGLVGSCVYFPQEKRAARCTLTSELVSAYGALGNITIVIGDGGTRRLTAAERKKCISVLFTADPNAKTRVVKFGALRKKLDLGSRDYFKGVPADDEKTREVFKPSGWRALYSTLRESNPQLLARLRDDIDLADAVMEAAAYASSASSLDNCLSQLPLDDDEKQALCALPYSSKVLNGYGSRSKKALDMLLACFEEPEVLNLIDAEAACGLDAMRLGGPRLERSEKLIPYEAWVSATGRTNNNPVVIRAMSQMRKVVNAICGKWGVPNEIHIELDRELRLPKRAKEEIAKANRKNEKERERIAIQAADILSCSPDEVSGRQIEKYRLWEEQENSDLYTGERIHVQRLLSDDTYTQIDHILPFSRTGENSRNNKVLVLSESNQQKREQTPYEWMNSGHPGAPSWDEFKLRVQANQHLKHRKKEFLLEQDLESKEVEFLQRNVTDTAYMSREVCAYLSDCLLFPDDGMKVHVVPTTGRATAWLRRRWGLNFGATGEKDRSDDRHHATDACVIAACSRSLVIKTAKVMKGTHWSVTRHMTPEERRDARMEALRESMPWESFANDVRDRRDSVVPTRYVPRKGSGELFEQTVYSYAGEVDSLSRQVIGKSGGKASPKANVFILDDGKSALLVGDMLCLRLWFDPEVKKKGKVVGGWYANPLYKADLPDLRKGTYVPKAVKPRHGRSAWLEIPERMLEQKPVEIYRGDLVEIDGKNGCFVGYNIANGSWTFVDPLTREEIDMPSLASLSSQTNLKVVRRGLLPMD

SEQ ID NO: 7592 - protein, 1007 aa, unidentified
  REGION 1..1007: note = Description of Unknown:uncultivated organism sequence
MIETEERGIGRLGRPRYLILGMDPGIASCGFALIDINNHEILEMGVRLFDAPLHPKTKQSLAVIRRGFRSTRRNIDRTQDRLKHCLECLKEYDVVPQDATKEYFHTIKGDRQPLNLRVDGLSRVLTSREWALVLYSLCKRRGYIPHGEGAQDKSSEGGKVLSAISANKEALEAGEFRTVGEWLASLPCSRNRAGNYDKCITHEQLIDETHVLFEKQRSLGSEYASEELEREYVEICNWERPRDEFDKRTYGLVGSCVYFPQEKRAARCTLTSELVSAYGTLGNITIVLGDGGTRRLTAAERDECIRVLFTADPNAKTRVVKFGALRKKLDLSSRDYFKGVSADDEKTREVYKPNGWRALYSTLRGSNPQLLARLRNDIDLADAVMEAAAYASSASSLDKCLSQLPLDDDERQALCALPYSSKVLNGYGSRSKKALDLLLAYLEEPEVLNLTDAEAACGLAAMRLGGPQLERSEKLIPYEAWLRATGRTNNNPVVIRAMSQMRKVVNAICGKWGVPNEIHVELDRELRLPKRAKEEIAKANRKNEKERERITIQAADILSCSPDEVSGKQIEKYRLWEEQENSDLYTGERIHVQRLLSDDTYTQIDHILPFSRTGENSRNNKVLVLSESNQQKREQTPYEWMNSGQPGAPSWDEFKLRVQANQHLKHRKKEFLLEQDLESKEVEFLQRNMTDTAYMSREVCAYLSDCLLFPDDGMRVHVVPTTGRATAWLRRRWGLNFGATGEKDRSDDRHHATDACVIAACSRSLVVKTAKVMKETHWSVTRNATPEERRDARMEALRESMPWESFADDVRARRDSVIPTRYVPRKGSGELFEQTVYSYGGAQDDKGRKIIGKAGGKASPKGNVVVLEDGKSALLIGDMLCLRLWRDFEVKKKGRVIGAWYADPVYKADVPSLQDGTYVPRIAKRGYGRSVWPRIPERLLSQRPVELYRGDLVEIDGKIGRFVGYNIANGSWTFADPLDGNEVEMPSLPSLNNETSLKVIRRGLVTS

SEQ ID NO: 7593 - protein, 512 aa, unidentified
  REGION 1..512: note = Description of Unknown:uncultivated organism sequence
MGRMRRIVNAIIRIYGVPDEIHIELGRDLKRSKHEKDLISKRNRENERKNKQWRAQAAEVQGIDPDEVRPKLLKKMSLWEEQGGLDAYTGHKIEFDRMISDDKYCEIDHVLPYSRTCDDSRNNKVLVLAKSNQDKRERTPYEWMTQDARKDAPSWNEYQARVIANRNISPKKRRYLLNNNLAPDQESDFLNRNLNDDRYMSRAVKSYLEDTLIFPEDGRKKHVIAVAGGATGNLRHVWGLNFGEGNTKDRSDGRHHAVDACVIAACSEATVQAVAKAHKLGAETYKRIREDRLRDTQPWPTFADEVIAQREFVIPTRMVSHGVTGRVFEDTNYRFDGLTDDNKKLGILYGNGKFTKKGNFVIGDDGNAHLVDGMAFLRLWIDPTARKGKGKWYAEPVYYADIPAIKNGTYVPRAGKISVARNAWEPIPEAARRTKPLVLFRGDVISMDGHTARYWSFGISTLTLKTKDLITGTEYKGFPTLSKWSKDSYPKKIQEDCLGHCYKGLVPKSLEG

SEQ ID NO: 7594 - protein, 1007 aa, unidentified
  REGION 1..1007: note = Description of Unknown:uncultivated organism sequence
MESERAYLVLGLDPGIASCGFCLLDMTNHKILEMGSRLFKTPQEDKTKVSLAVTRRNARSARRNNERTKSRMKHCMDILADEGLIPEDADKTWFQSKKGDKPILKLRSCGLNRALTDREFAQVLYSLCGHRGYIPHGEGKDAETDDSEGKKVLNAIKRNTEEMAAGGYRTVGEMLHSRGKSRNRGGNYDFCVYNSQIQSEVHAIFEAQRALGNLKANEKFEDRYLECLTWEKKSSNHDKKVYDQVGTCIYFPELKRAADADVSSELCRAYEKLGHLVIVHVDGAEQRLTGEQISHYIGILFSPTPLNNNKYCKVTYSTIRSDLDLSGKSVFKGVPQEKEKDEVFVPKAWRCLRKVLANDHEDLLDRMLNDRELGDAICEALTFSSSETSLQEQLEPLGLAEDECVALSSIPFNGKLFKGYGSRSIKALSILLGAFEEPGVQTLADAEKATGLDRKRLEDRVARSELLPPYNTYDETCRNPVVLRAMGQMRHIVNAIIRIYGVPDEIHIELGRELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNLNDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHGVTGCVFEDFSYSLEGIDEKGYAHISRQTDRTTGECRSLKASNFEIVNETTVKLLDSMAFLRLWHDPHAGKTGRWYIEPVYCADIPNLDGKTYHPRYQKQKVARSGWPLVPAEALKNKPLLLFRGDVLIVGNHIARYWKFDIGGGKVTMLSIVDINSEAKGFPSISKWKNDMPVRILSEDCLASCYKHMTIDSENSTFEER

SEQ ID NO: 7595 - protein, 1000 aa, unidentified
  REGION 1..1000: note = Description of Unknown:uncultivated organism sequence
MAEPYLVLGLDPGISSCGFALLDMSNHKILEMGSHLFDAPQDSQTKVSLAVGRRNARSARRNNLRTKNRQKHCMELLQEAGLVPQGVTKQWFQSTKGDRPLLELRFAALERPLTNREFAQVLYALSARRGYIPHGEGRISKLSDMDTSGSSDAEAGKVLRAIGENNKLMAQGRFRTVGEMLYDQGKSRNKGGSYERCVLNSQIVDEVHIIFQSQRTQQNTTATQELEAEYIQNLTWEKRTLDHDAKVHALVGKCSYFPDEFRAARADLSSELCNAYERLKHLRIVNADGDEVALAPEQVETYIAILFSPEPLKGKKEKVTYARIRKGLDLSAHLFFKGIDPEDEKDHEPYAPKAWRAMRKVLSTELMERLRSDRTLADAVGEALTYASSEDSLVYQLDNLDLRDEERNQILALPFSGKIFKGYGSRSLKALDMLVDAFEESEVTTLAEAEESSGLFGFRMSDSGARYPLLPSYSNYDKENRNPVVLRAMGRMRRIVNAIIRIYGVPDEIHVELGRDLKRSKHEKDLINKRNRENERKNKQWRAQIAEEQGIDPDEVRPKLLRKIALWEEQDNFDIYTGHKIEFDRMISDDKYCEIDHVLPYSRTCDDSRNNKVLVLAKSNQDKRERTPYEWMTQDARKGTPNWDEYQARVIANHHISPRKRRYLLNNNLGPDQESDFLSRNLNDDRYMSREVKSYLEDTLIFPEDGRVKHVIAVSGGATGSLRHVWGLNFGANNSKDRSDNRHHAVDACVIAACSESTLQAVAKARKLGAETYKRMRKDRLKDTQPWPTFADEVIARREFVIPTHMVSHGVTGRAFEDTNYRFDGITNDTKKLGILYGNGKTTKKGNFVIGSDGNAHLVDGMAFLRLWLDPTARKGKGKWYAEPVYYADIPAIKNGTYKPRAAKAHVARVAWEPVPENALASAPVVLFSDSVIKVGSAIARYSRFDIGNAALVLENLKTGEECKKFPTLGRWNNELVPIIINEDCLGHCYKELVPNILEG

SEQ ID NO: 7596 - protein, 1000 aa, unidentified
  REGION 1..1000: note = Description of Unknown:uncultivated organism sequence
MAEPYLVLGLDPGISSCGFALLDMSNHKILEMGSHLFDAPQDSQTKVSLAVGRRNARSARRNNLRTKNRQKHCMELLQEAGLVPQGVTKQWFQSTKGDRPLLELRFAALERPLTNREFAQVLYALSARRGYIPHGEGRISKLSDMDTSGSSDAEAGKVLRAIGENNKLMAQGRFRTVGEMLYDQGKSRNKGGSYERCVLNSQIVDEVHIIFQSQRTQQNTTATQELEAEYIQNLTWEKRTLDHDAKVHALVGKCSYFPDEFRAARADLSSELCNAYERLKHLRIVNADGDEVALAPEQVETYIAILFSPEPLKGKKEKVTYARIRKGLDLSAHLFFKGIDPEDEKDHEPYAPKAWRAMRKVLSTELMERLRSDRTLADAVGEALTYASSEDSLVYQLDNLDLRDEERNQILALPFSGKIFKGYGSRSLKALDMLVDAFEESEVTTLAEAEESSGLFGLRMSDSGARYPLLPSYSNYDKENRNPVVLRAMGRMRRIVNAIIRIYGVPDEIHVELGRDLKRSKHEKDLINKRNRENERKNKQWRAQIAEEQGIDPDEVRPKLLRKIALWEEQDNFDIYTGHKIEFDRMISDDKYCEIDHVLPYSRTCDDSRNNKVLVLAKSNQDKRERTPYEWMTQDARKGTPNWDEYQARVIANHHISPRKRRYLLNNNLGPDQESDFLSRNLNDDRYMSREVKSYLEDTLIFPEDGRVKHVIAVSGGATGSLRHVWGLNFGANNSKDRSDNRHHAVDACVIAACSESTLQAVAKARKLGAETYKRMRKDRLKDTQPWPTFADEVIARREFVIPTHMVSHGVTGRAFEDTNYRFDGITNDTKKLGILYGNGKTTKKGNFVIGSDGNAHLVDGMAFLRLWLDPTARKGKGKWYAEPVYYADIPAIKNGTYKPRAAKAHVARVAWEPVPENALASAPVVLFSDSVIKVGSAIARYSRFDIGNAALVLENLKTGEECKKFPTLGRWNNELVPIIINEDCLGHCYKELVPNILEG

SEQ ID NO: 7597 - protein, 641 aa, unidentified
  REGION 1..641: note = Description of Unknown:uncultivated organism sequence
MLNDRELGDAICEALTFSSSETSLQEQLEPLGLAEDECVALSSIPFNGKLFKGYGSRSIKALSILLGAFEEPGVQTLADAEKATGLDRKRLEDRVARSELLPPYNTYDETCRNPVVLRAMGQMRHIVNAIIRIYGVPDEIHIELGRELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNLNDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHGVTGCVFEDFSYSLEGIDEKGYAHISRQTDRTTGECRSLKASNFEIVNETTVKLLDSMAFLRLWHDPHAGKTGRWYIEPVYCADIPNLDGKTYHPRYQKQKVARSGWPLVPAEALKNKPLLLFRGDVLIVGNHIARYWKFDIGGGKVTMLSIVDINSEAKGFPSISKWKNDMPVRILSEDCLASCYKHMTIDSENSTFEER

SEQ ID NO: 7598 - protein, 1088 aa, unidentified
  REGION 1..1088: note = Description of Unknown:uncultivated organism sequence
MKYRLGLDIGITSVGWAVLEHNDEEAPFRITDLGVRIFPVAENPKDGSSLALPRREARSSRRRLRRHRHRLDRIKRLFEDFNLISLENLSYIYHKPQPLTDIYELRQAGLDRLLNQEEWARVLIHLAQRRGYKSNRKTDSNNKNATETGKLLAAVNENNALMAAKSYRTVGEMFYLDEKFSQHKRNKADEYNHTVSRNQVSDEIVKLFNAQRKYDNSFADTRFEKLYSEVLLGQRSFDEGPGSPSPYAGNLIEKMVGKCTFEKELPRAAKATYSFQLFNLLQKINSLRIENVNGSSRALNRGERQTIADLAHKKSDLKYSDIRKHLILTPNHRFNSITYSSIDIDEVETKSKFTYLNDFHKIRIALDRVTRGRVNQLSTEQKDAIGETLTLFKNENTIADKLSQAGLSKYDIEALMSLSFRGFGHLSLKALKNIIPYLQEGLVYSEATTLAGYNYRAHDNGNKYIYLPANGEELKDITNPVVRRAVSQSIKVINAIIRKYGSPQLICIELAREMSKNFFDRKRIEKQIKENTDLNDEIRNKIIEYGHSNPTGQDIVKMKLWQEQDGRCAYSGAPIPISTLFEPGVADVDHIIPYSVSFDDSYANKVLVKSEENRQKGNLLPYEYLKVDDVRLERFLVWVNTNVHNYRKKQRLLKQDITAEDLSKWKERPLNDTKYISRFMLNYIRDYLQFAPSNNFKKRQVISVNGSITAYMRKRWGLKKERYAGDLHHAMDAAVVACVSEGMIRKITRYSQYCEAKNIRNRFRDYESNELIDPLQERFGVRFIEPWDKYKLELESRLSDDPAIRIKAYNLKNYLNPENVEPIFVSRMPQHKNRGVAHKDTIRSGRLLEEGLTVSKVDIRKLKLDADGEIKGYYNQSSDLKLYNALKKQLHDFGGDASKAFKETFYKPASAGKTPLPVKKVKIVDASTLSVNVGNGIAANGDMLRIDIFKTADGYYWVPIYVNDTVKPNLPNKAVLAAKPLDLWIEMQDDDFIFSLYSNDLVRFVHKTGTNFNCWDESKINLKESFMYYIKANINNAALEVVSHDRSYSKSSLGIKSLVAFEKWNVDILGNRSLVKKETRQYFPGQTK

SEQ ID NO: 7599 - protein, 1087 aa, unidentified
  REGION 1..1087: note = Description of Unknown:uncultivated organism sequence
MKYIIGLDMGITSVGFASMMLDDNDEPCRIIHMGSRIFEAAENPKDGSSLAAPRRENRSMRRRLRRKRHRKERIKNLIIQNNMMTADEIDAIYNSGKELPDIYKVRAEALDRKLDTEEFVRLLIHLSQRRGFKSNRKVDAKEKGSEAGKLLSAVKSNKELMVERNYRTIGEMLYKDEKFAEFKRNKADDYSNTFARSEYEEEIREIFRAQQEYGNPYATEELKDSYLEIYLSQRSFDEGPGGDSPYAGNQIEKMVGSCTLEPDEKRAAKATFSFEYFNLLTKVNSIKVVSSAGKRSLNEDERKRVIKLAFAKNAISYASIRKELNLGDGERFNISYSQSDKSIEEIEKKTKFTYLTAYHTFKKAYGSVFNEWSAEKKNHLAYALTAYKNDNKIKKYLTENGFDAVETDIALTLPSFSKWGNLSEKALNNINPYLEQGMLYHDACTAAGYNFKADDTDKRMYLPAHEKEAPELGDIPTPVVRRAVSQTIKVVNAIIREMGESPCFVNIELARELSKNKAERSKIEKGQKENQARNDRIMERLRNEFGLLSPTGQDLIKLKLWEEQDGICPYSLKPIKIENLFDVGYTDIDHIIPYSLSFDDTYNNKVLVMSSENRQKGNRIPMQYLDGKRRDDFWLWVGSSNLSRRKKQNLLKETLSDDDLSGFKKRNLQDTQYLSRFMLNYLKKYLTVAPNATGRKNTIQAVNGAVTSYMRKRWGIQKVREDGDTHHAVDAVIISCVTAGMTKRISEYAKYKETEYQNPETGEYFDVNKNTGEVINRFPMPYAWFRNELLMRCSEDPSRILHEMPLPNYATDEAVAPIFVSRMPKHKVRGSAHKETIRQSFEEDGKKFTVSKTPLTDLKLKNGEIENYFNPESDVLLYNALKERLIAFGGDAKKAFEAPFHKPKSDGSEGPLVKKVKLICKSTLTVPVLKNTAVADNGSMVRVDVFFVEGEGYYLVPIYVSDTVKKELPNKAIVAHKPYEEWKEMREENYVFSLYQNDLIGIKLKKEMKFSLVQKNSTLPKNINVKDGLFYYKGTNISGANISVINNDNTYTVESLGVKRIPVIEKYQVDVLGNVSKVGKEKRVRFQ

SEQ ID NO: 7600 - protein, 1087 aa, unidentified
  REGION 1..1087: note = Description of Unknown:uncultivated organism sequence
MKYIIGLDMGITSVGFASMMLDDNDEPCRIIHMGSRIFEAAENPKDGSSLAAPRRENRSMRRRLRRKRHRKERIKNLIIQNNMMTADEIDAIYNSGKELPDIYKVRAEALDRKLDTEEFVRLLIHLSQRRGFKSNRKVDAKEKGSEAGKLLSAVKSNKELMVERNYRTIGEMLYKDEKFAEFKRNKADDYSNTFARSEYEEEIREIFRAQQEYGNPYATEELKDSYLEIYLSQRSFDEGPGGDSPYAGNQIEKMVGSCTLEPDEKRAAKATFSFEYFNLLTKVNSIKVVSSAGKRSLNEDERKRVIKLAFAKNAISYASIRKELNLGDGERFNISYSQSDKSIEEIEKKTKFTYLTAYHTFKKAYGSVFNEWSAEKKNHLAYALTAYKNDNKIKKYLTENGFDAVETDIALTLPSFSKWGNLSEKALNKIIPYLEQGMLYHDACTAAGYNFKADDTDKRMYLPAHEKEAPELGDITNPVVRRAISQTIKVVNAIIREMGESPCFVNIELARELSKNKAERSKIEKGQKENQARNDRIMERLRNEFGLLSPTGQDLIKLKLWEEQDGICPYSLKPIKIENLFDVGYTDIDHIIPYSLSFDDTYNNKVLVMSSENRQKGNRIPMQYLDGKRRDDFWLWVGSSNLSRRKKQNLLKETLSDDDLSGFKKRNLQDTQYLSRFMLNYLKKYLTVAPNATGRKNTIQAVNGAVTSYMRKRWGIQKVREDGDTHHAVDAVIISCVTAGMTKRISEYAKYKETEYQNPETGEYFDVNKNTGEVINRFPMPYAWFRNELLMRCSEDPSRILHEMPLPNYATDEAVAPIFVSRMPKHKVRGSAHKETIRQSFEEDGKKFTVSKTPLTDLKLKNGEIENYFNPESDVLLYNALKERLIAFGGDAKKAFEAPFHKPKSDGSEGPLVKKVKLICKSTLTVPVLKNTAVADNGSMVRVDVFFVEGEGYYLVPIYVSDTVKKELPNKAIVAHKPYEEWKEMREENYVFSLYQNDLIGIKLKKEMKFSLVQKNSTLPKNINVKDGLFYYKGTNISGANISVINNDNTYTVESLGVKRIPVIEKYQVDVLGNVSKVGKEKRVRFQ

SEQ ID NO: 7601 - protein, 1087 aa, unidentified
  REGION 1..1087: note = Description of Unknown:uncultivated organism sequence
MKYIIGLDMGITSVGFASMMLDDNDEPCRIIHMGSRIFEAAENPKDGSSLAAPRRENRSMRRRLRRKRHRKERIKNLIIQNNMMTADEIDAIYNSGKELPDIYKVRAEALDRKLDTEEFVRLLIHLSQRRGFKSNRKVDAKEKGSEAGKLLSAVKSNKELMVERNYRTIGEMLYKDEKFAEFKRNKADDYSNTFARSEYEEEIREIFRAQQEYGNPYATEELKDSYLEIYLSQRSFDEGPGGDSPYAGNQIEKMVGSCTLEPDEKRAAKATFSFEYFNLLTKVNSIKVVSSAGKRSLNEDERKRVIKLAFAKNAISYASIRKELNLGDGERFNISYSQSDKSIEEIEKKTKFTYLTAYHTFKKAYGSVFNEWSAEKKNHLAYALTAYKNDNKIKKYLTENGFDAVETDIALTLPSFSKWGNLSEKALNNINPYLEQGMLYHDACTAAGYNFKADDTDKRMYLPAHEKEAPELGDITNPVVRRAVSQTIKVVNAIIREMGESPCFVNIELARELSKNKAERSKIEKGQKENQARNDRIMERLRNEFGLLSPTGQDLIKLKLWEEQDGICPYSLKPIKIENLFDVGYTDIDHIIPYSLSFDDTYNNKVLVMSSENRQKGNRIPMQYLDGKRRDDFWLWVGSSNLSRRKKQNLLKETLSDDDLSGFKKRNLQDTQYLSRFMLNYLKKYLTVAPNATGRKNTIQAVNGAVTSYMRKRWGIQKVREDGDTHHAVDAVIISCVTAGMTKRISEYAKYKETEYQNPETGEYFDVNKNTGEVINRFPMPYAWFRNELLMRCSEDPSRILHEMPLPNYATDEAVAPIFVSRMPKHKVRGSAHKETIRQSFEEDGKKFTVSKTPLTDLKLKNGEIENYFNPESDVLLYNALKERLIAFGGDAKKAFEAPFHKPKSDGSEGPLVKKVKLICKSTLTVPVLKNTAVADNGSMVRVDVFFVEGEGYYLVPIYVSDTVKKELPNKAIVAHKPYEEWKEMREENYVFSLYQNDLIGIKLKKEMKFSLVQKNSTLPKNINVKDGLFYYKGTNISGANISVINNDNTYTVESLGVKRIPVIEKYQVDVLGNVSKVGKEKRVRFQ

SEQ ID NO: 7602 - protein, 1087 aa, unidentified
  REGION 1..1087: note = Description of Unknown:uncultivated organism sequence
MKYIIGLDMGITSVGFASMMLDDNDEPCRIIHMGSRIFEAAENPKDGSSLAAPRRENRSMRRRLRRKRHRKERIKNLIIQNNMMTADEIDAIYNSGKELPDIYKVRAEALDRKLDTEEFVRLLIHLSQRRGFKSNRKVDAKEKGSEAGKLLSAVKSNKELMVERNYRTIGEMLYKDEKFAEFKRNKADDYSNTFARSEYEEEIREIFRAQQEYGNPYATEELKDSYLEIYLSQRSFDEGPGGDSPYAGNQIEKMIGSCTLEPDEKRAAKATFSFEYFNLLTKVNSIKVVSSAGKRSLNEDERKRVIKLAFAKNAISYASIRKELNLGDGERFNISYSQSDKSIEEIEKKTKFTYLTAYHTFKKAYGSVFNEWSAEKKNHLAYALTAYKNDNKIKKYLTENGFDAVETDIALTLPSFSKWGNLSEKALNNINPYLEQGMLYHDACTAAGYNFKADDTDKRMYLPAHEKEAPELGDITNPVVRRAVSQTIKVVNAIIREMGESPCFVNIELARELSKNKAERSKIEKGQKENQARNDRIMERLRNEFGLLSPTGQDLIKLKLWEEQDGICPYSLKPIKIENLFDVGYTDIDHIIPYSLSFDDTYNNKVLVMSSENRQKGNRIPMQYLDGKRRDDFWLWVGSSNLSRRKKQNLLKETLSDDDLSGFKKRNLQDTQYLSRFMLNYLKKYLTVAPNATGRKNTIQAVNGAVTSYMRKRWGIQKVREDGDTHHAVDAVIISCVTAGMTKRISEYAKYKETEYQNPETGEYFDVNKNTGEVINRFPMPYAWFRNELLMRCSEDPSRILHEMPLPNYATDEAVAPIFVSRMPKHKVRGSAHKETIRQSFEEDGKKFTVSKTPLTDLKLKNGEIENYFNPESDVLLYNALKERLIAFGGDAKKAFEAPFHKPKSDGSEGPLVKKVKLICKSTLTVPVLKNTAVADNGSMVRVDVFFVEGEGYYLVPIYVSDTVKKELPNKAIVAHKPYEEWKEMREENYVFSLYQNDLIGIKLKKEMKFSLVQKNSTLPKNINVKDGLFYYKGTNISGANISVINNDNTYTVESLGVKRIPVIEKYQVDVLGNVSKVGKEKRVRFQ

SEQ ID NO: 7603 - protein, 1271 aa, unidentified
  REGION 1..1271: note = Description of Unknown:uncultivated organism sequence
MESKNTMESKNTKESKNTKVRFGLDIGIASVGWSVIECDESGYAVDIVAAGSRVFTAAEVPGSDEGLGEARRSARGARRSARGARRRNRRHKFRLHRAKRLIVESGMLSQQQLDNLYDNSQPKQDIYEIRYRALDSVLTNQEFAKLLIHLLQRRGYKSNAKDTKVLDSQTDESKKAKAKATESEKTDDEAALKSIANNKIILSQYRSVGEMIYNDSKFRLNVGGNQVSVKGNYVFKARNSTGDYKFVMLRAWIVDEIKLIFERQFALGNHQYANPQLKDKYLEIFESQRHYSEGPGGIESKYGIEGINYHRQKQGLQPLISLIEKMTGKCTFEPQEERAVKASYSFEKFRLYQDFNHISIVDGRKNSRQHLTQEQFDALVKHAHDKEKITYKDIRKVLNLSQDCKFSNVDYKPKVKKDKDGNPIQDDQSKDPESDAKILGLPKYHAIKRVLKGVSIDITTLTTAQLNCIATVVSKYKDDNDLVEKLETELVKNGLDSVVAHNISQASLELSFSGVGHLSIKAVDKILDVWQVGDTYDQAVTRAGYDFKSEWTGERFKKLSLLEHAENGGTKPINNPVVRRSVGQVIKVVNSLVETYGSPIGINIELARDMAKSKKERQDIEKANKQNRERNERAKQEAVELRKSNSKLDSNPTGLDIVKINLYRQQNCICMYSGKSIDNTRLLEDGYVEVDHIVPYSISFNDSYQNKVLVFGEENQQKGNRLPLQYLTGEKRERYIANVERIFGKNLGKRSRLLKTVITDEDRNKFIERNLNDTRYATKVIANTLKNYLLFDEVVHTKDTQKKRVITVNGTMTSYIRARFGLNKVRNNGDTHHALDAIVVACTTDSYIQQISKYNKLIENKYRKPDITNQIDLETGEIIATIEEWVDYETGEVLTKEEYFKRGLHTKQTNSHVKKELERQLFDNEMSPLSNYKATQFRNLVTQLIEQSQGLHDGNPVHVDGKDTHINKIFVSRKLNRKATGQGHQETTFGKVAKIKSSEVGVCKDRVQENEQLDPTLMVKRTELKNLKLDKDGEIDNYYKPDSDKLLYQALKQYLKEQSKLPEKDKFKEPFYKPIRNQDGTMTFGNVVLKVNTIEKKSSFVTLKNNGAAANGGMIRIDVFKVENAPKKGDNGYYWVPVYVNDFVKHTLPNLARPSLKEMKDEDFIFSLYPNDCIYVKHKDNMEFTREDEVVEGDKVVKNISKTTCNDVYIYYVKAGISGGAITVKSHDSLYNLSSLGVKGLKEISKCSVDTLGNITKITTKQVREKFPNQK

SEQ ID NO: 7604 - protein, 1271 aa, unidentified
  REGION 1..1271: note = Description of Unknown:uncultivated organism sequence
MESKNTMESKNTKESKNTKVRFGLDIGIASVGWSVIECDESGYAVDIVAAGSRVFTAAEVPGSDEGLGEARRSARGARRSARGARRRNRRHKFRLHRAKRLIVESGMLSQQQLDNLYDNSQPKQDIYEIRYRALDSVLTNQEFAKLLIHLLQRRGYKSNAKDTKVLDSQTDESKKAKAKATESEKTDDEAALKSIANNKIILSQYRSVGEMIYNDSKFRLNVGGNQVSVKGNYVFKARNSTGDYKFVMLRAWIVDEIKLIFERQFALGNHQYANPQLKDKYLEIFESQRHYSEGPGGIESKYGIEGINYHRQKQGLQPLISLIEKMTGKCTFEPQEERAVKASYSFEKFRLYQDFNHISIVDGRKNSRQHLTQEQFDALVKHAHDKEKITYKDIRKVLNLSQDCKFSNVDYKPKVKKDKDGNPIQDDQSKDPESDAKILGLPKYHAIKRVLKGVSIDITTLTTAQLNCIATVVSKYKDDNDLVEKLETELVKNGLDSVVAHNISQASLELSFSGVGHLSIKAVDKILDVWQVGDTYDQAVTRAGYDFKSEWTGERFKKLSLLEHAENGGTKPINNPVVRRSVGQVIKVVNSLVETYGSPIGINIELARDMAKSKKERQDIEKANKQNRERNERAKQEAVELRKSNSKLDSNPTGLDIVKINLYRQQNCICMYSGKSIDNTRLLEDGYVEVDHIVPYSISFNDSYQNKVLVFGEENQQKGNRLPLQYLTGEKRERYIANVERIFGKNLGKRSRLLKTVITDEDRNKFIERNLNDTRYATKVIANTLKNYLLFDEVVHTKDTQKKRVITVNGTMTSYIRARFGLNKVRNNGDTHHALDAIVVACTTDSYIQQISKYNKLIENKYRKPDITNQIDLETGEIIATIEEWVDYETGEVLTKEEYFKRGLHTKQTNSHVKKELERQLFDNEMSPLSNYKATQFRNLVTQLIEQSQGLHDGNPVHVDGKDTHINKIFVSRKLNRKATGQGHQETTFGKVAKIKSSEVGVCKDRVQENEQLDPTLMVKRTELKNLKLDKDGEIDNYYKPDSDKLLYQALKQYLKEQSKLPEKDKFKEPFYKPIRNQDGTMTFGNVVLKVNTIEKKSSFVTLKNNGAAANGGMIRIDVFKVENAPKKGDNGYYWVPVYVNDFVKHTLPNLARPSLKEMKDEDFIFSLYPNDCIYVKHKDNMEFTREDEVVEGDKVVKNISKTTCKDVYIYYVKAGISGGAITVKSHDSLNNLSSLGVKGLKEISKCSVDTLGNITKITTKQVREKFPNQK

SEQ ID NO: 7605 - protein, 1084 aa, unidentified
  REGION 1..1084: note = Description of Unknown:uncultivated organism sequence
MKYGIGLDIGITSIGHAVMLLDDNDQPCRIMKMGSRIFDAAENPKDGSSLAAPRRENRGMRRRLRRKRFRKERIKSLIEQSGIMGVKEIDAIYQSSTELPDIYEIRCRALDRLLNKEEFVRLLIHLSQRRGFKSNRKVDSKDKKSDAGALLSAVEENKRLLEGKGYRTIGEMLFKDEKFADCKRNKADSYSNTFARQDYCDEIKLIFSRQREFGNAFSIEKFENDFLEIYLSQRSFDDGPGGKSIYGGNQIEKMLGKCTFEKGELRAVKASFSFEYFNLLSKVNAIKIVSADGKRALTENERSKIVSLAFSKNSITYKSLRKELGLSDSEHFNISYGEKSVEETEKKMKFTYLNAYHTFKKAYGEAFVQWSTDKKNALAYALTVYKNDNKITAFLTDKGFDDAEISIALTLPSFSKTGNLSVKALEKIMPFLEQGQLYNEACLSAGYNFKADEQCKGKYLPANPETAVELQDLTNPVVRRAVSQTIKVINAIIREFDDSPVFVNIELARELSKNFKDRKDIEKSQKENKAANERIMERLRNEFHILKPTGQDLIKLKLWEEQDGICPYSLKPISIDRLFEIGYTDIDHIIPYSISFDDTYNNKVLVLSSENRQKGNRLPMQYLSEDKKDAFYLWVDNSNLRNRKKKNLLKETLTDDDLSGFKKRNLQDTQYISRFLLNYLKKYLQLAPNSKDRKNTIVAVNGAATAYVRKRWGISKIRENGDVHHAVDAVVIACITQAMIKRISEYSKYHENEHIDNNGEYFDIDKRTGEMINRFPMHYPYFRQELEILCSNNPSRYLLESPLPNYSVGEDVKPIFVSRMPKRKITGAAHKDTIRKPYEIDGKNCAVSKVALTSLKLKDGEIENYFNPSSDILLYNALLERLKQFNGDAKAAFEEKFYKPKSDGSKGPLVKKVKIIEKSTLTVPLHNGTAIADNDSMVRTDVFYVDGEGYYLVPIYVADTVKKELPNKAIVAYKPYEQWKEMSDKNFLFSLYPNDLIHIVSKKDMKFSLVNKDATLAKNCVSKDAFVYFKGTDIATASIAAINHDNTYKLRGLGVKSLLSIEKCQVDVLGNITKAGREKRMGFR

SEQ ID NO: 7606 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLPDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLKIEKLFSEGYAEVDHIVPYSISFDDSYSNKVLVHTNENQNKGNRIPLNYLSGKERDEFIVWVKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPEDDRLLYDALKNHLIKFKEMHKEENGKKKVEDAFTEPFYKPKSDGSKGSLVKSVKIIKKITSSVTLNNNTTIAKNGDMIRTDVFRTEDGYYLVPIYVADTVKNELPHKAIVQGGEWKVMNDEDFLFSLYRNDLIKIKSNSDVTFSLMNESSSLPKTESLREEFVYFKETSINTASIRVVTHDNCYIKKSLGVKNLQSLEKYQVDVLGNVSKVKKEKRMGFR

SEQ ID NO: 7607 - protein, 1079 aa, unidentified
  REGION 1..1079: note = Description of Unknown:uncultivated organism sequence
MECSNSLKYIIGLDIGTTSVGYAALMLDDKDIPCRILRLGSRIFDLAENLNGSSHAAPRRENRGMRRRQRRKRLRKSEIKSLISENNIMTGDEIKAIYNSKGVLSDIYQIRAEAIDRNLNKEEFVRLLIHLSQRRGFKSNRKVDSNNKKSEAGTLLIAIEENKKILNKNHYRTIGEMLYKDKKFTEYKRNKSDSNKNSFTRKEHEEEIKCIFESQRKFGNKYATKDLEEKYLKIFLSQRAFDDGPGANSPYAGNQIEKMLGHCTLEPDQFRAVKASYSFEYFNLLSKVNHIKILSSGTKRPLSPDERSKVISLAFNKNSITYASIRNALKLSQSETFNISYGEKSIDEIEKKTKFTYLKAYHTMKKAYGDSFNSWSTDKKNNLGYALSVYKNDSKIISYLTDKNFDETEIKIALTLPSFSKTGNLSVKALDKINPYLEQGMVYSDACISAGYNFKADDTEKSKYLPANPMVAEELQDIKNPVVKRAVSQTIKVVNALIREYGSPCYVNAELARELAKNFKDKKEIEKGQKENRAKNERIMERLRSEFGLLQPTGLDLVKLKLWEEQDGICPYSLKPIKIERLFETGYVEIDHIIPYSLTFDDSYNNKVLVLSSENRQKGNKIPMQYLSGKQKDSFYVWVENSNLKSYKKKNLLKESLSKDDLSRIKSRSLNDTRYISRFILNYIKKYLEFEPNSTNNKKTVTAVNGAATAYIRKRWGINKIRENGDIHHAVDAVVIASVTDSIIRLISEYSKYHETEYDNPKTGEVVNRFPMPYPYFKAEIDMLCSEDPSVELRRNPLPNYATDEHIEPVFVSRMPKHKNTGAAHEDTIRKPYCENGINYVISKVPLSSLELKNGEIKDYYNASSDMLLYNALKKRLEQSGGKGTNAFKDPFYKPKSDGTQGPLVKKVKTIQKATLTVDVQNKTAVAKNDSIIRTDVFYVEGEGYYLVPIYVSDTVKKVLPNKAVVGSKSYNDWKVMNDENFIFSLYPSDLIRVVSNTVKKFSLVNKNSTLKDTIDSKDIFLYFKKTKIANAAITVINHDNTYTIPSLGVKELLKLEKYQVDVLGNKSKCGKEKRMGFN

SEQ ID NO: 7608 - protein, 1086 aa, unidentified
  REGION 1..1086: note = Description of Unknown:uncultivated organism sequence
MSYGLGIDCGIASVGSGTVLLNEKEEPYKIDFMCVRIFDKAETGTGKSLAAERRSFRGSRRTHRRKTHRKDRIKKLICDTMNVDFKYIQSIYERKNLSDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVTLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLNIEKLFSEGYAEVDHIVPYSISFDDSYSNKVLVHTNENQNKGNRIPLNYLSGKERDEFIVWVKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPNKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 7609 - protein, 1068 aa, unidentified
  REGION 1..1068: note = Description of Unknown:uncultivated organism sequence
MYRLGLDIGTTSVGAAILNIDHYGEPNRIIDMHVRTFEAAENTKDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATAENEKYLKEKGYRTVGEMLWKDERFAGNKRNKGGDYSNTFLRSQLKEEIGIIFERQKAFGSLYVTDAFSEKYLEILFSQRAFEEGPGEESPYAGNQIEKMVGKCTFEKEEKRAPKATYTFELYNLWQKINSIGILQDGVKRRLTDDERNKLFALCHKTEKIDYKRIRKELELGQDALFSNLTYGQKEVEEVEAAKFQYLPVYHEMRKAFNKISKNHVLQISNTQRDLIGTAITYYKTDDKIQQALLEGNFSKEEINAILGMKNFSKFGSLSIKAMQKVIPYLEKGLTYDKACEQAGYDFRAHSVAEKKKYLPKLPGDTYDITSPVVKRAINQTIKVVNEIIKRHGSPAAVNIELAREMSKSFKDRKRIEKEQNDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVANKEEYEIRVNTLIKNRANREQQLKPILTEEDMGEMKQRSLQDTQFITRFMMNYIRDYLLFDEAYDRKQRVTAVNGRVTAYMRKRWGINKVREDGDLHHSVDAVVVACITPGIVQMVTEYAKREENRYLNKDDVAMRERFPMPWPEFSTELDIRTCKEPKEMLQKVSLANYQDVDIDSIKPIFVSRMTKKKVTGQAHKETIRAYREVDGKMRTVTKTSIQKLELDKDGEIERYYNPSSDILLYELLRSRLKEAGGNGKEAFPEGFVYKPTPNGGVAPKVKKVKIYAVSNLNIPVNHGVAANGAMVRIDLYYVEGEGYYFIPIYISDLMKEELPKKACVPHKEYHDWKNMKDEDFLYSIYPNDLLYIKSSTPKKFAKKRGEKKDSFEAEEAFVYYREAGISGATITVETHDNNYTIQSLGVKTLSRIEKYHVDVLGNKYKAAVEERK

SEQ ID NO: 7610 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLSDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLEIEKLFSEGYAEVDHIVPYSISFDDSYSNKVLVHTNENQNKGNRIPLNYLSGKERDEFIVWVKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIVCVTKSMIKRISEYSKYKETLYIKNNDETLDVDKKTGEVKNYFPMPYKWFRTELDIRCSKNPERFLESNPLPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQSGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 7611 - protein, 1068 aa, unidentified
  REGION 1..1068: note = Description of Unknown:uncultivated organism sequence
MYRLGLDIGTTSVGAAILNIDHYGEPNRIIDMHVRTFEAAENPNDGSSLAAPRREARGARRRNRRHKHRLDRIKALIQSEGIYTKEKLDSLYHAKGNILMDIYQIRYESLERKLNNEELTRLLIHFAQRRGFKSNRKNEKKGSDEGKLLAATADNEKYLKEKGYRTVGEMLWKDERFAENKRNKGGDYSNTFLRSQLKEEIGIIFEKQKAFGSLYVTDAFSEKYLEILFSQRAFEEGPGGESPYAGNQIEKMVGKCPFEKEEKRASKATYTFELFNLWQKMNSIGILQDGIKRRLTDDERNKLFALCHKTEKVDYKRIRKELEMGQDALFSNLTYGRKEVEEVEAAKFQYLPVYHEMRKAFDKISKNHILQISNTQRDLIGTAITYYKTDDKIQQALLEGNFSKEEINAILGMKNFSKFGSLSVKAMQKVIPYLEKGLTYDKACEQAGYDFRAHSVAEKKKYLPKLPGDTYDITSPVVKRAINQTIKVVNEIIKRHGSPDAVNIELAREMSKSFKDRKRIEKEQNDNAAQNQRIYDEIKDTFHVAQPSGQDIVKYKLWQEQDCKCVYTGQPIKAENLFVPGYYEVDHIIPYSISFDDSYTNKVLVLTKANRDKGNRIPMQYVADKEEYEIRVNTLIKNRAKREKLLKPILTEEDIGEMKQRSLQDTQFITRFMMNYIKDYLLFDEAYDRKQRVTAVNGRVTAYMRKRWGINKVREDGDLHHSVDAVVVACITPGIVRTVTEYAKREENRYLNKDDAVMREKFPMPWPEFSTELDIRTCKEPKEMLRKVSLANYQDVDIDSIKPIFVSRMTKKKVTGQAHKETIRAYREVDGKMRTVTKTPIQELKLDKDGEIEGYYNPSSDILLYELLRSRLKEAGGNGKKAFPEGFVYKPTPNGGVAPKVKKVKIYDVSNLNIPVNHGVAANGNMVRIDLYYVEGEGYYFIPIYISDLIKKELPKKACVPHKEYHDWKNMKDEDFLYSIYPNDLLYIKSSTPKKFTKKKGEKKDSFEAEEAFVYYREAKISGATITVVTHDNNYTIQSLGVKTLSRIEKYHVDVLGNKYKAAVEERK

SEQ ID NO: 7612 - protein, 1091 aa, unidentified
  REGION 1..1091: note = Description of Unknown:uncultivated organism sequence
MSYGLGIDCGIASVGSGTVLLNEKEEPYKIDFMCVRTFDKAETGTGKSLAAERRSFRGSRRTHRRKTHRKDRIKKLICDTMNVDFKYIQSIYERKNLSDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVTLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLNIEKLFSEGYAEVDHIVPYSISFDDSYSNKVLVHTNENQNKGNRIPLNYLSGKERDEFIVWVKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPNKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFRWWDIG

SEQ ID NO: 7613 - protein, 1084 aa, unidentified
  REGION 1..1084: note = Description of Unknown:uncultivated organism sequence
MKYSIGLDIGITSVGYAVMLLNHDEQPCRILKMGSRIFEAAENSKDGSSLAAPRRENRGMRRRLRRKRFRKERIKALIEQKGIMTVEEIDNIYKSRAELSNIYEIRSRALDKLLIKEEFVRLLIHLSQRRGFKSNRKVDSQNKNSEAGALLTAVEENKKLLISKGYRTIGEMLYKDDKFSQCKRNKADSYSNTFARQDYYDEIKLIFSKQREFGNIFASDSLENDFLEIFLSQRSFDAGPGGNSIYGGNQIEKMLGKCTFEKDELRAVKASFSFEYFNLLSKVNAIRIVSAGAKRTLTEDERNHIIKLAFKKKSITYKSLRNELGLSDSECFNISYGDKSLEDTEKKMKFNYLNAYHTFKKAYGDSYLQWSVDKKNTLAYALTVFKNDDKIIAYLSKNDFDDSEIQIALTLPAFSKTGNLSVKALEKIIPFLEQGQIYNEACKNAGYNFKADEECKCEYLPANPENATELQELTNPVVRRAVSQTIKVINAIIREFDESPVFVNIELARELSKNYKDRKDIEKSQKNNRVSNERIMERLRNEFHLINPTGQDLVKLKLWEEQDGICPYSLKPIIIDRLFEAGYTDIDHIVPYSISFDDSYNNKVLVLSSENRQKGNRLPMQYLGENKKDEFYLWVDNSNLRNRKKKNLLKETLTDDDLSGFKKRNLQDTQYISRFLLNYLKKYLILAPNSNDRKNTIVAVNGAATAYVRKRWGISKIRANGDVHHAIDAVVIACITSAMIKRISEYSKYHENEYIDNNGEFYDVDRKTGEVINRFPLPYSHFRQELEILCSETPERYLSKCQLPYYSVGEDVKPIFVSRMPKRKIAGAAHKDTIRRPYEIGGEKFSVSKVALTSLKLKNGEIENYFNPSSDILLYNALLERLKQFNGDAKAAFAEKFFKPKSDGSRGPLVKKVKTIEKATLTVPVHNGTAIANNDSMVRTDVFYVEGEGYYLVPIYVADTVKKQLPNKAIIPRKSYDNWKEMNDDDFLFSLYPNDLIHIVSKKDMKYSLVNKDATLAKNFLTKDICVYFRKSSISTASISVINHDNTYEIPSLGVKGLLMLEKCQVDVLGNVTKSGREKRMRFR

SEQ ID NO: 7614 - protein, 1087 aa, unidentified
  REGION 1..1087: note = Description of Unknown:uncultivated organism sequence
MKYIIGLDMGITSVGFATMMLDDKDEPCRIIRMGSRIFEAAEHPKDGSSLAAPRRINRGMRRRLRRKSHRKERIKDLIIKNELMTADEISAIYSTGKQLSDIYQIRAEALDRKLNTEEFVRLLIHLSQRRGFKSNRKVDAKEKGSDAGKLLSAVNSNKELMIEKNYRTIGEMLYKDEKFSEYKRNKADDYSNTFARSEYEDEIRQIFSAQQEHGNPYATDELKESYLDIYLSQRSFDEGPGGSSPYGGNQIEKMIGNCTLEPEEKRAAKATFSFEYFNLLSKVNSIKIVSSSGKRALNNDERQSVIRLAFAKNAISYTSLRKELNMEYSERFNISYSQSDKSIEEIEKKTKFTYLTAYHTFKKAYGSVFVEWSADKKNSLAYALTAYKNDTKIIEYLTQKGFDAAETDIALTLPSFSKWGNLSEKALNNIIPYLEQGMLYHDACTAAGYNFKADDTDKRMYLPAHEKEAPELDDITNPVVRRAISQTIKVINALIREMGESPCFVNIELARELSKNKAERSKIEKGQKENQVRNDRIMERLRNEFGLLSPTGQDLIKLKLWEEQDGICPYSLKPIKIEKLFDVGYTDIDHIIPYSLSFDDTYNNKVLVMSSENRQKGNRIPMQYLEGKRQDDFWLWVDNSNLSRRKKQNLTKETLSEDDLSGFKKRNLQDTQYLSRFMMNYLKKYLALAPNTTGRKNTIQAVNGAVTSYLRKRWGIQKVRENGDTHHAVDAVVISCVTAGMTKRVSEYAKYKETEFQNPQTGEFFDVDIRTGEVINRFPLPYARFRNELLMRCSENPSRILHEMPLPTYAADEKVAPIFVSRMPKHKVKGSAHKETIRRAFEEDGKKYTVSKVPLTDLKLKNGEIENYYNPESDGLLYNALKEQLIAFGGDAAKAFEQPFYKPKSDGSEGPLVKKVKLINKATLTVPVLNNTAVADNGSMVRVDVFFVEGEGYYLVPIYVADTVKKELPNKAIIANKPYEEWKEMREENFVFSLYPNDLIKISSRKDMKFNLVNKESTLAPNCQSKEALVYYKGSDISTAAVTAINHDNTYKLRGLGVKTLLKIEKYQVDVLGNVFKVGKEKRVRFK

SEQ ID NO: 7615 - protein, 1091 aa, unidentified
  REGION 1..1091: note = Description of Unknown:uncultivated organism sequence
MNYIIGLDIGITSVGYAVLMLNDNDIPCRILKMGSRIFEIAENPKDGSSLAAPRRINRGMRRRLRRRRFRKGQIRNLIIQNNIMTNDEIISIYNSGKELTDIYKIRCEALDRELDKEEFVRLLIHLSQRRGFKSNRKVDASDSKSEAGKLLNAVKTNKTLMEEKGYRTIGEMLYKDERFADVKRNKADDYSNTFARSEFEAEINAIFDAQQKFGNEYASDEMRDSYLKIYLSQRAFDEGPGGDSPYGGNQIEKMLGKCTFEPDEFRSVKAAYSFEYFNLLTKVNSLKLITPEEKRFLTKEEKDKIINLAFSKKTISYASIRKELGILADTYFNISYGKGDITPEETEKKTKFTYLIAFHVFRKAYGDVFLNWSKDKKNSLGYALTVYKNDSKISDYLKNKGFDKAEIDIALTLPSFSKTGNLSIKALDKLIPFLEQGMLYNEACAAAGYNFKNDDTSKRKFLPANEEDAPELGDIRNPVVRRSVSQTIKVINAIIRKYGESPTLVNIELARELSKAKKDRDKIEKNQKDNRSRNEAIVEELKNTFHILQPTGQDVVKYKLWKEQDGICPYSLKSISLDKLFDVGYTDIDHIIPYSVSFDDTYNNKVLVLSSENRQKGNRLPMEYLKGKKRDDFWLWVDNSNLRSRKKKNLLKEQITEEDISGFKKRNLQDTQYISRFLLSYLKKYLELQPNGSAIKNTIKAVNGAATAYVRKRWGINKIRENGDIHHAVDAVVIGCITNPMIKKISEYSKYRELEFVNPHTDEILDIDTRTGELVNRFPMPYDWFRDELIMRTSSDPTRVLHEKPLPNYATDEEVSPIFVSRMPKRKVSGAAHKDTIRRKYVNEVGLEYTVSKVPLSSLRLKNGEIEGYFNPSSDMLLYNALKSRLAMYDGDGKKAFADSTEPFRKPKHDGTDGPIVKKVKIQNKATLSVQVQNKTAIADNGSMVRVDVFFVENEGYYLVPVYVSDTVALDLPNRAIVGGKPYSKWKEMDNDNFVFSLYPNDLIKVKSKRDMKFNLVNPDSTLAKNYTARESMLYYKGTDISTAAITAINHDNTYKLRGLGVKSLLSIEKYSVDVLGNKTKVNKEKRMGFV

SEQ ID NO: 7616 - protein, 1054 aa, unidentified
  REGION 1..1054: note = Description of Unknown:uncultivated organism sequence
MKYIIGLDIGITSVGYAVLLLNDKGIPCRIIKMGSRIFEIAENPKDGSSLAAPRRINRGMRRRLRRRRFRKEQIRSLITERKIMSADEIDSIYNSGKELSDIYKIRCEALDRKLDKEEFVRLLIHLSQRRGFKSNRKVDASDSKSEAGKLLNAVKTNKALMEEKGYRTIGEMLCKDERFADVKRNKADDYSNTFARSEYEAEIKAIFDAQQTFGNEYANDGLRDSYLKIYLSQRAFDEGPGGESPYRGNQIEKMLGRCTFESDEVRFVKAAYSFEYFNLLSKVNSIKLITPEGKRPLTKEARDRIIDLAFNKKTISYASIRKELGLSDDVYFNISCGKGEKTPEETEKKTKFTYLNAYHTFKKAYGDAFLSWSSEKKNILAYALTVYKNDSKITDYLNENGFDKAETDIALTLPSFSKTGNLSLKALDKLIPFLEQGMLYNEACAAAGYNFKNDDTSKRMFLPANEEDAPELGDIRNPVVRRSVSQTIKVINAIIREYGESPTLVNLELARELSKTKKDRDKIEKGQKENNSRNEAIIEELKNTFHILQPTGQDIVKYKLWKEQDGVCPYSLKSISLDKLFDVGYTDIDHIIPYSISFDDTYNNKVLVLSSENRQKGNRLPMEYLKGKKQDDFWRWVDNSNLRLRKKKNLLKEQITEEDISGFKKRNLQDTQYISRFLLNYLKKYLELQPNDFGTKNTIKSVNGAATAYVRKRWGINKIRENGDIHHAVDAVVIGCITNPMIKRISEYSKYRELEFVDPHTKEILDIDIRTGELVNRFPMPYDWFRDELLMRTSNDPTRVLHEKPLPNYGTDEEVAPIFVSRMPKRKISGAAHKDTIRRKHVDEVGVEYTVSKVPLTSLKLKNGEIEGYFNPASDMLLYNALKDRLAMYGGDGKKAFADSTEPFRKPKHDGTDGPIVKKVKIQNKATLSVQVQNKTAIADNGSMVRVDVFFVEEEGYYLVPVYVADTVKPELPNRAIVGGKPYDKWKEMDNDDFVFSLYPNDLIKVKSKRDMKFNLVSPDSTLAKNYAARESMLYYIGTDISTAAITAINHDNT

SEQ ID NO: 7617 - protein, 1087 aa, unidentified
  REGION 1..1087: note = Description of Unknown:uncultivated organism sequence
MKYIIGLDMGITSVGFASMMLDDNDEPCRIIRMGSRIFEAAENPKDGSSLAAPRRENSSMRRRLRRKRHRKERIKNLIIQNNMMTADEIDAIYNSGKELPDIYKIRAEALDRKLNTEEFVRLLIHLSQRRGFKSNRKVDAKEKGSEAGKLLSAVKSNKELMVERNYRTIGEMLYKDEKFAEFKRNKADDYSNTFARSEYEEEIREIFRAQQEYGNPYATEELKDSYLEIYLSQRSFDEGPGGDSPYAGNQIEKMVGSCTLEPDEKRAAKATFSFEYFNLLTKVNSIKVVSSAGKRSLNEDERQRVIKLAFAKNAISYASIRKELNLGDGERFNISYSQSDKSIEEIEKKTKFTYLTAYHTFKKAYGSVFNEWSAEKKNHLAYALTAYKNDNKIKKYLTENGFDAVETDIALTLPSFSKWGNLSEKALNKIIPYLEQGMLYHDACTAAGYNFKADDTDKRMYLPAHEKEAPELGDITNPVVRRAISQTIKVVNAIIREMGESPCFVNIELARELSKNKAERSKIEKGQKENQSRNDRIMERLRNEFGLLSLTGQALIKLKLGEGQEGIDPSSVKPIKIENLFDVGYTDIDHIIPYSLSFDDTYNNKVLVMSSENRQKGNRIPMQYLDGKRRDDFWLWVGSSNLSRRKKQNLLKETLSDDDLSGFKKRNLQDTQYLSKFMLNYLKKYLDLAPNDSGRKNTVQAVNGAVTSYMRKRWGIQKVREDGDTHHAVDAVIISCVTAGMTKRISEYAKYKETEYQNPETGEYFDVDKNTGEVIDRFPMPYAWFRNELLMRCSEDPSRILHEMPLPNYATDEAVAPIFVSRMPKHKVRGSAHKETIRQSFEEDGKKFTVSKTPLTDLKLKNGEIENYFNPESDVLLYNALKERLIAFGGDAKKAFEAPFHKPKSDGSEGPLVKKVKLICKSTLTVPVLKNTAVADNGSMVRVDVFFVEGEGYYLVPIYVSDTVKKELPNKAIVAHKPYEEWKEMREENYVFSLYQNDLIGIKLKKEMKFSLVQKNSTLPKNINVKDGLFYYKGTNISGANISVINNDNTYTVESLGVKRIPVIEKYQVDVLGNVSKVGKEKRVRFQ

SEQ ID NO: 7618 - protein, 1087 aa, unidentified
  REGION 1..1087: note = Description of Unknown:uncultivated organism sequence
MKYAVGLDIGISSVGYAVMMLDETDMPSAILKMGSRIFDAAENPKDGSSLAAPRRNNRGMRRRLRRKRFKKEQIKDLIVKNGIMSYSDINEIYNSGKVLSDIYSIRAEALNRILTKEEFVRLLIHLSQRRGFKSNRKVDASDSKSEAGKLLDAVNKNKSLMEEKHYRTIGEMLFIDEKFAKNKRNKAEDYANTFARSEYVAEINTIFDAQKVFGNEYAIDELKEDYLKIYLSQRSFDEGPGGNSPYSGNQIEKMLGKCTFEKKEFRAVKASFTFEYFSLLSKVNSLKLKSSTEKRFLTKAERDAVIALSFNKKNISYASIRKELNLPNDTLFNISYGNGDKTVEEIEKKSKFTYLNAYHTFKKAFGDSYINWSTDKKNHLGYAIALYKNDNKIAEYLSEHGFDKSEIKIALSLPSIPKAGNLSLKAMNKIIPYLEEGMIYNEACKAAGYNFKADETDKRMFLPANEEDAPELGDIRNPVVRRSISQTIKVTNAIIREFGESPCFVNIELARELSKTKKERNEIEKNQLENRNHNEEIVKELKSTFGLLQPTGQDIVKYKLWKEQNGICPYSLEPILIENLFDIGYTDIDHIIPYSISFDDTYNNKVLVLSSENRQKGNRIPMQYLTGKKKDDFWLWVDNSNLRARKKKNLLKEEITDDDISGFKKRNLQDTQYISRFMLNFLKKYLNTQPNSSGKKNTIIAVNGAATAYIRKRWGINKIRENGDTPHAVDAVVIACVTDSMIKKISEYSKHKETEFVHPETKEIKDIDLRTGEIINKFPMPYNWFRDELVMRTSNNPTRILHEKPLPNYGTDQKVEPIFVSRMPNHKVKGSAHEETIRKKYEEDNKTYSVSKVSLSSLKLTNGEIENYFNPSSDMLLYNALKQRLAMFGGNGSKAFEEPFYKPKSDGSQGPLVKKVKIQSKSTLSVPVLKGTAIADNGSMVRVDVFFVEGEGYYMVPIYVSDTVKPELPNKAIIANKPYTEWKEMKEQDFLFSLYPNDLIRIKFNKEKQFSLVQKDSTLAKNLLLSEGYFYYKKASISSASITIINNDNTYTVASLGVKRIPLIEKYQVDVLGNIQKVGKEKRMRFR

SEQ ID NO: 7619 - protein, 1087 aa, unidentified
  REGION 1..1087: note = Description of Unknown:uncultivated organism sequence
MKYIIGLDMGISSVGFATMMLNEKDEPCRIMHMGSRIFEAAEHPKDGSSLAAPRRENRSMRRRLRRKCHRKERIKNLIVSNNILTADEIDTIYNSGKDLTDIYQIRAESLDRKLNTEEFVRLLIHLSQRRGFKSNRKVDAKEKGSEAGKLLSAVNSNKELMTEKNYRTIGEMLYKDDKFAVFKRNKADDYTNTFAREEYEEEIQKIFSAQQEYGNQYATDELKEGYLEIYLSQRSFDEGPGGNSKYAGDQIEKMVGFCTLEPDEKRAAKATYSFEYFNLLTKVNSFKILSAEGKRSLNENERQKIIKLAFNKNAISYASLRKELSVGYSERFNISYSQSDKSIDEIEKKTKFTYLTAYHTFKKAYGSALIEWSTEKKNHLAYALTAYKNDNKIKNCLTEHGFNETECEIALTLPSFSKWGNLSEKALNKIIPYLEQGMLYHDACTAAGYNYKADDTDKRMYLPAHEKEAPELENISNPVVRRAVSQTIKVINAIIREIGESPCFVNIELARELSKNKTERNKIEKGQKDNQARNDRIMERLRNEFGLISPTGQDLIKLKLWEEQDGICPYSLQAISIERLFEAGYTDIDHIIPYSISFDDTYNNKVLVMSSENRQKGNRIPMQYLQGKRRDEFWLWVDSSNLSRRKKQNLLKETLSDDDLSGFKKRNLQDTQYLSRFMLNYLKKYLKLAPNATGRKNTIQAVNGAVTSYMRKRWGIQKVRENGDTHHAVDAAVISCVTAGMTKRISEYAKYKETEYQYPENGEYFDVDKRTGEVINRFPMPYPWFRNELLMRCSENPSRILQEMPLPNYAADEAVDPIFVSRMPKHKAKGSAHKETIRKAFEEDGKKYTVSKVPLEDLKLKNGEIENYFNPKSDTLLYNALKSRLIEFCGDAKKAFEAPFYKPKSDGSKGPLVKKVKIVNKATLTVPVLKNTAVADNGSMVRVDVFFVEGEGYYLVPIYVADTVKKELPQKAIIANKTYENWKEMKEENFVFSLYPNDLIRIKSKKEMKFNLVNKESTLAPHYQSKDAYVYYKGSDISTAAITAITHDNTYKLRGLGVKTLLAIEKYQVDVLGNIIKIGREKRMRFR

SEQ ID NO: 7620 - protein, 1078 aa, unidentified
  REGION 1..1078: note = Description of Unknown:uncultivated organism sequence
MNYRLGLDIGITSVGWAVLEHDSSEEPFRIADLGVRIFDRAEHPKDGSALALPRREARSSRRRIRRHRHRLERIKALLESQGIITIEKLQEVYHGSKELTDIYELRCLGLDNLLTQEEWARVLIHLAQRRGFKSNRKKEIKENKKEKNEDGKLLAAVRDNQALMQEKNYRTIGEMFYRDDKFSLNKRNKSELYSHTVGREQILDEIAQLFTAQRRLGNSYAGEKVEQLYTDIVSRQRSFDEGPGTPSPYAGNLIERMRGKCTFEKEEPRAAKACYSFELFNLLQKINSLRIDDKNSASRPLNKEERQLLIQSAHEKADIKYTDLRKKLQLSPEQRFNTLSYGRDDVEEIEKKNKFNYLKAYHDIRIALDKVSKGRIKQLPVEHIDMIGEILTLYKNEDRITSKLRKTGLTEYDIEELLSLSYSGFGRLSLKAIKNILPYLQEGHIYSEASTLAGYNFRGHDNVVKQMYLPANNEQLQDITNPVVRRAVSQTIKVINAVIRKYGSPQLICIELSREMGKNFFDRKRIEKQIKENTDLNDAVRNKIIEYGHLNPTGLDIVKMKLWQEQDGRCAYSGEPISIQDLFDAGIADVDHIIPYSVSFDDSYANKVLVKSSENRQKGNLLPLEYMKNNPNKQEKFIVWVNTNVRNFRKQQRLLKKTITEEDRNKWKERQLNDTKYISRFMLNYIRDYLEFAPAENIGKRKVISVNGNITAYMRKRWGLKKDRLAGDLHHAQDAVVVACVTEGMIQKITRYSQYCEAKNNRSHFVDYETGEVIDTLRNRFGADFVEPWDNFKIEMVSRLSDDPALRIDAYKLDNYLDLKDIKPIFISRMPNRKNKGAAHQETIRSSRLTGEGLVVSKINITKLKLDADGEIANYYNPKSDMRLYNALKNRLQQFNGNGEAAFKEPVYKPAAPGKTISPVKKVKVIDKSNLNVAVGKGVAANGDMLRIDVFKKGDGYYWVPIYVADTVKETLPNKACVHSKPYELWKEMDDNDFIFSLYPNDLIRFIPNNGEEAFMYYIKAGISTASITVESHDRSQSIPSLGVKTLKILEKWNVDVLGNRTLVKNEKRQYYPGQTTR

SEQ ID NO: 7621 - protein, 1070 aa, unidentified
  REGION 1..1070: note = Description of Unknown:uncultivated organism sequence
MNYRLGLDIGITSVGWAVLEHNEEEEPVKIVDLGVRIFDRAENPKDGSSLARPRREARSARRRIRRHRHRIERIKRLLEDYRVISLAELESLYHSSQSLTDIYELRYYGLERRLSNQEWARVLIHLAQRRGFKSNRKKENEKEEGKLLAAVKSNQDIMHDKGYRTVGEMFYLDPKFALHKRNKADDYSHTIGRQQVLDEISLLFARQRELGNPHTTIEFENVYKDIVSGQRSFDLGPGDPSPYAGNQIEKMRGNCTFEKDCPRAAKACYSFELFNLYQKINSLRIESAQETSRFLTAEERELIVQLAHQKADLNYSTIRNILELRDEQWFNNLTYGLDNTKETEKKSKFNYLKSYHQIRKAMDSVSKGRIQQFTVSQLDLLGETLTLYKNEGSISRILSEAGFSKQDIDAVLSLNFRGFSHLSLKAIRNILPWLEKGQVYSEAATSAGYNFRGHDSQPQKYLPLKNEQLDNITNPVVRRAVSQSIKIINAIIRKYGSPQLICIELSREMGKSFDERKVIEKQIKENNALNEQVRQKIIEFGHSNPSGQDIVKMKLWQEQDGRCAYSGDPIPIERLFEPGVADVDHIVPYSISFDDSYANKVLVRSSENRQKGNLLPYEYMKNDPVKLERFIVWVNTSVKNYHKKQRLLKKSITDEDRNKWNERPLNDTKYISRFMLNYIRNNLQFAPAEYLGKRRVITVNGSITAFLRKMWGLKKERLAGDLHHAQDAVVVACVSESMIQKITRYYQYYETRYSSNHFVDRETGEIINARQEKFGIKFVEPWEGFRFELESRLSDDPVFRIKAYNLKNYLNPDEVKPVFVSRMPTRKNRGLANEATIRSPRLVEEGFFISKVNITDLILNANGEIKGYYQPQSDLRLYEALKSRLREFNGDGKKAFKEPFYKPTKTGKLGPLVKKVKVIEKSNLNVLVGSGIAANGDMIRIDVFKTEEGYFWVPIYVADTVKKTLPNKAALQSKPYELWPEMSDDDFIFSLYPNDLIRFQREKDKDEFMYYKKAGISTASITVESHDRSYSIPSLGVKTLLLLEKWEVDVLGNRYRVKKERRQYFPGQVR

SEQ ID NO: 7622 - protein, 1097 aa, unidentified
  REGION 1..1097: note = Description of Unknown:uncultivated organism sequence
MKYGIGLDIGIASVGSAIVLLDGSDEPYKIYRLSSRVFPKAETDKGESLASDRRNNRGMRRRLRRRRHRKERIRNLIYDVFDVNEDYITEIYAESGLKDIYQIRYEALDRKLDKDEFIRLLIHLSQRRGFKSNRKSDVGKKDDGKLLDAVKKNTELRQKMYRTIGEMLYCDDRFADSKRNTEGNYKNTFSRSEYGEEIKCIFENQRAFGNEYATEDFEEKFIGIIMSQRSFDEGPGPGKDSKYSGNLIERLVGKCTFEREEMRAPKASYTFEYFNLLSKINAIKIVSANNTRCLTEEQRAIIKNLAFSKNDLSYKSLRKALGLNEDELFNISYTDSDTNKKKAKNKKGTADKFSERDAVEDKTKFSYLKAYHTFKKAYGDEYDRWSTDKKNYLGYVLTVFKTDKNVELKLRERNFSDDEINIAQTIPSFSKLGNLSVKAMNKMIPFLENGEIYNKAAEMAGYNFKADDKCAGMYLPANESKAPELGDIANPVVRRSVSQTIKVINAIVREMGESPVYVNIELARDLAKSHDEREKIEKNNNANRQKNDKLMEELRKEFKLANPKGEDLIKLKLWNEQNGRCMYSYEPIVRERLFEPGYAEIDHIIPYSISFDDTMSNKVLVKAKENRDKGDRLPLQYMTGKKADDFRVRVSNSILSRKKKNNLLKEQLTEEDRKSFKQRNLQDTQYISRFMMNFIKKYLKFAGEAKIVAVNGRATDYMRKRWGIRKIRADGDTHHAVDACVVACATHGMVQRISEYSKYKETEYIDDDGRIYDINKKTGELTDRFPMPYPMFRKELEMLTSNDPQRILSQSKFPNYSGDEQLEPIFVSRMPQHKVTGAAHEDTLRKPVTENGQNYVVQKVKLTKLKLNDNGEIENYYMPQSDKLLYNALKERLAEYGGDGEKAFKNLTEPFRKPKSDGTPGPIVTKVKTIEKQTCGVPLADNTTIADNGPMVRVDVFYVAGEGYYLVPIYVSDTVKKELPNRACVANKPYSEWKVMDDKNFLFSLYNNDLVKITFKREKKFSLVNKDSTLDKEHRTKSELLYYKGTNIHTASITVITHDNTYIFEGMGVKTLISIEKYEVDVLGRVRKVNKEKRMGF

SEQ ID NO: 7623 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNDYCFTRHTETKYDKKHTNKADERFMRYASASSLLRDFTAKVSINVIGDIIEK

SEQ ID NO: 7624 - protein, 1070 aa, unidentified
  REGION 1..1070: note = Description of Unknown:uncultivated organism sequence
MLPEHMDEHIIDLWQLRADAATEGKQLTLPQIGRVLYHINQKRGYKHAKADVSADSKQTKYVAEVNQRYKDIQERNQTIGQYFYQKLVESAVQAPSGPYYTFRIKDQVFPRAAYMAEFDQIMQTQKQFYPEVLTPELIDTLRNQIIFYQRPLKSCKHLVGLCEFEMKAYTNKATGKVVYSGPKCAPRTSPLAQLCAMWEAANNITLFNKSNEYLPITLVQRQAIVEHLNTHEKLTAKDLQKILGISPKEGWSAGKAVGKGIKGNMTFNQLRQALGGKYDHLLQMNMQMVDYVDEATGEVISRISEAIEQEPLYRLWHVVYSVQEREELGKALHKQFGIDDEAVVEALFKIDFVKPGYANKSHKFIRKLLPYLMKGYKYSEACDHIYVNHSNSMTKEQNATRELVDKIPLLLKNELRQPIIEKILNQMINIVNALKEQHGNIDEVRVELARELKQSKDERAHTTERINKNERENKAIEERIREHGIRPSRARIQKYKMWEESQHQCFYCGKSISAAEFLSGADVEVEHIIPKSILFDDSFSNKVCACRACNHAKGNMTAREFMETRSQAELEAYLSRVNAAFEEGRISKTKRDHLLWHKEEIPQDFIDRQLRQSQYISKKAVEILRSAIRDVYATSGSVTDFLRHIWGYDQILHQLNLPKYRDAELTEWVTYDHRGQEHQEERIKNWSKRIDHRHHAIDALTIALTRQGYIQRLNNLNASHDDMAEAVRKVNPLMEKKYSLLEKYIYIQPHFTVQEVTDKVDGILVSFRAGKKVTTPAKRAIYRKGKRINVQDGLLVPRGALTEETVYGKLGNKYVVKYPLTHPSMKVDDIVDPTIREIVRARLAAFSGKAKDAFAKPLYSDAAQKMEIKTVRCYTGLQDKAVASVRFNAQGEAIGFAKTGNNHHIAIYQDAKGQYQESVVSFWQAVERKRYGLPIVIEDSKAIWDKVMDMDLPQEFLETLPKDDWQFVVSLQANEMFILGLEDADFEMAMENRDYQLLNKHLYRVQKIGSKDYSFRHHIETSVDDKYDGMQNRQLSVTMKKLYRFNSIGAFNTQHPHKVRVNLLGEISEV

SEQ ID NO: 7625 - protein, 1319 aa, unidentified
  REGION 1..1319: note = Description of Unknown:uncultivated organism sequence
MGVGVWECSMSYMSSMSAMGIKKAPDKGRGQPKCFHNGIILIVICIKLVSQNYTNFFINQIKSNIFIKFVEKLILNTIKKITMKKVLGIDLGVGSMGWSLIEVDSTNSPTQIVAMGSRIVPLSTDDANEFTTGKAITKNQKRTAKRTSRKGYDRYQQRRENLTIEFRKLGMLPDEKLVKLPVMDLWQLRADAATPGKKLSLPEIGRVLYHINQRRGYKHAKADENGDSKQREYVANVNKRHAMIIERGQTIGQYFAEQLKASEIKNDKGVFYTYRIKEQVFPRKAYEDEFDQIIKVQKEFYPEILTEQVINRLRNEIIFYQRGLKSCKHLVSICEFEKKEYRNAKGEIVFDGPKVSPRTSPLFQVCKMWESINNIKLTNRNNEIFPITKEHRKLMFEHLDNNEKLGIKDLYKILGISAKGGWWAGKAIGKGLQGNTTKMQLEEKLSLLPKDKINKLLEFNLSQCDSGLVDEETGEIIPIIDHNFIKEPLYKLWHVIYSIQDKNELKKTLAKSFDITDEETINNLHKIDFVKPGYGNKSAKAMRRILPFLQKGEMYSNACAHAGFRHSESLTTEENLRRELLPKLPQIKKNELRQPIVEKILNQMVNVVNAIIDKYGKPDIIRVELARELKMSKEERESMDKNIRAREKENEAIKEKILEFDGVRVSRNRVQKYRMWQESQESCFYCGERVSAAEFLNGFDVEIEHIIPRSLFFDDSFSNKVCACRKCNASKGNMTGYDFMKSKSEDAFQNYLTRIDEAFKEHRISKTKRDRLLTTASDIPTDFIDRDLRLSQYISRKSVEILKQVCRDVYTTTGSVTDFVRRVWGYDMVLHNLNIDRYRKGELTEFVEFDHKGQKHIEERIVGWSKRIDHRHHAIDALVIAMTQQSFIQRLNHLNTERDQMFAEIEKQCEEWRNDFSMLEQWLRERPHFTVAEVEKVVSEIMVSFKAGKKVATKNKRIKYVKGKKVVLQDNIIVPRGALSQESVYGKIRVLERNKPIKFAFENPHLIFKGYIKRLVEKRLEQFNGDYKKAVASLKKTPIMIGANKDVPLTYATCYKDEYVIKYPIASLTKMSDIDSIVDENIKLRIKARIEQFGGKIKEAFKDLDNNPIYADDLNSIPIKNVRCFTGLNAVTPLKYNDKGEAISFVKPGNNHHIAIYRDKEGNLQEHVVTFWTAVERKKYGIPVIIKSPVDVWDRLTDRDIPEAFLATLPNVSWEFVESMQVNEMFILGLSDDEFNDAISNNDKVTLCNHLYRVQKIAYLYYSFRLHIETSVDDKYNGVKDESLSISLGKYKRVRSLNGLVNLNPHKIKITNLGDIIVE

SEQ ID NO: 7626 - protein, 1158 aa, unidentified
  REGION 1..1158: note = Description of Unknown:uncultivated organism sequence
MATKKVLGLDLGVGSIGWALIELENDNPTSILGMGSRIVPLTTDDSTQFQKGQAITKNADRTQRRTARKGYDRYQMRRKNLTEVLRKHGMLPERTDEHIIDLWQLRADAATEGKQLTLPQIGRVLYHINQKRGYKHSKADVSADSKQTKYVAEVNQRYKNLLERNQTIGQYFCQMLKETAVMAASGLYYTFRIKDQVFPRAAYVAEFDQIMTAQKVYHPNVLTEELIHQLRNEIIFYQRPLKSCKHLVGLCEFEKKAYTNKAGQVVYDGPKCAPRTSPLAQLCAVWETVNNISLSNRKGEHLEITLAQRQAMVEWLCNNEKMTAKDLQKILSISPKEGWYAGKAVGKGIKGNSTLYQLRKALGKKYEELLKMDLPLVDVAIYESTGEVVQYVAEQVEQEPLYRLWHVVYSVQDEEQLRKALRKLGIEDEEVIDNLFKIDFVKPGYANKSHKFIRKILPYLMQGYHYSEACEHVGIKHSKSETKEENEVRELVAKIPLLMKNELRQPIIEKILNQMINIVNALKEKHGEIDEVRIELARELKQSKDERAHATERINKNERENKAIEEKIREFGIRPSRARIQKYKMWQESQERCFYCGKQIGAAEFLSGFDVEVEHIIPRSVLFDDSFSNKVCACRACNHTKGNMTARDFMATQGKDKLEEYLSRVDTAFKEGRISKTKRDHLLWSKEDIPQDFIDRQLRQSQYIAKKAAEILYPAFRHVYATSGSVTDFLRHIWGYDEILHQLNLAKYRDAEMTEVVTYDHRGQEHQEERIKNWSKRIDHRHHAIDALTIALTKQGYIQRLNSLSASHDEIEAAVREKNPVMDRKYSLLEKYIYIQPHFTVQEVTDAVDGILVSFRAGKKVTTPAKRAKYHNGKRVIVQDGLLVPRGALTEETVYGKLGDKYVVKYPLNHPSMKVDEIVDPTIREIVRARLAAFGGKAKDAFAKPLYSDAAQTMEIKSVRCYTGLQDRAVAAVRYNEQGEAVGYTKTGNNHHIAIYQDANGQYQELVVSFWQAVERKRYGLPIVIEDPKAVWDRVMDMDLPQAFLETLPKDNWQFVVSLQANEMFILGLEDGDFEMAMENKDYQLLNKHLYRVQKIGSKDYSFRYQIETSVDDKYDGVHNRALSLTMKKLISIRSFGSWFAQYPHKVRVNLLGEIAEV

SEQ ID NO: 7627 - protein, 1159 aa, unidentified
  REGION 1..1159: note = Description of Unknown:uncultivated organism sequence
MATKKILGLDLGVSSIGWALIEMEDDKASSILGMGSRIVPLTTDDSTQFSKGQAITKNADRTARRTARKGYDRYQLRRAKLTQVLRQHNMLPERMDEHVIDLWQLRADAATEGKQLTLQQIGRVLYHINQKRGYKHAKADMSADSKQTKYVAAVNLRYQEIQELKQTIGQFFYQQLVNTAVQTPSGPYYTFRIKDKVFPRAAYVAEFDQIMQVQKVFYPEVLTAELINTLRNEIIFYQRPLKSCKHLVGLCEFEMKAYTNKHTGQVVYSGPKCAPRTSPLAQLCAIWEAVNNITLYNRRNEYLDITLEQRKAMVEHLCNNEKLTAKDLQKILGISSKEGWSVGKALGKGLKGNITLHQLRKALGKQYSHLLQFNLQMTDYVDEATGEVISRVTDTVENEPLYRLWHVVYSVQDREELGKALQKQFGIDEEDVVEALFEIDFVKPGYANKSHKFIRKLLPYLMKGYKYSEACEHIGINHSYSITKEQNEARELVDKIPLLLKNELRQPIIEKILNQMINIVNALKEQYGNIDEVRVELARELKQSKDERAHATERINKKERENKTIEERIKEYGVRPSRARIQKYKMWQESQERCFYCNTGVSATEFLSGADVEVEHIIPRSVLFDDSFSNKVCACRACNHAKGNMTAREFMETRSQAELEAYLSRVNTAFEEGRISKTKRDHLLWRKDEIPQDFIDRQLRQSQYIAKKAVEILRSAIRDVYATSGSVTDFLRHIWGYDQILHQLNLPKYRDAELTEWVTYDHRGQEHQEERIKNWSKRIDHRHHAIDALTIALTRQGYIQRLNNLNASHDDMAEAVRKVNPLMERKYSLLEKYIYIQPHFSVQDVTSAVDSILVSFRAGKKVTTPAKRAIYRKGKRINVQAHIQVPRGALTNEHVYGKLNDQYVIKYALLDQSMKVDKIVDPTIREIVRARLEAFGGNAKAAFAEPLYSDAAQKMKIKSVRCYTGLQDKAVAAVRFNEQGEAIGFSKTDNNHHIAIYQDKNGQYQESVVSFWQAVERKRYGLPIVIEDPKAIWDKVMDMDLPQEFLETLPKDDWQFVVSLQANEMFILGMEDGDFEMAMENRDYQLLNKHLYRVQKMSSKDYSFRHHIETTVDDKYDDKPNRALSLQMKKLISIRSFGGWLAQHPHKVRVNLLGEISEV

SEQ ID NO: 7628 - protein, 1221 aa, unidentified
  REGION 1..1221: note = Description of Unknown:uncultivated organism sequence
MKKILGLDLGVASIGWSLIEVDENNKPVKILGLGSRIVPLTTDDATEFTTGNAISKNAKRTEKKTARKGYDRYQMRRAALTEELRSNDMLPDEHLIKLPSLALWQLRANAATPGHKLSLLEIGRVLYHINQKRGYKHAKSDESSDSKQKAYVADVNARYTMIIERGQTIGQYFAEKIKESECITDKGALYTYRTKDQVFPRKAYEAEFDQIMSVQRSFYPDILTDDVIDKLRNEIIFYQRGLKSCKHLVSLCEFEKKEYVNKSGKIIFDGPKVAPKSSPLFQICKIWESVNNIVLKNRRGEELFIDKTQRKAMFDFLNDNEKMTLTDLYKILNISKSDGWWAGKAIGKGLQGNTTKIALKKALQDLDGVSKLLKFDLKTEDTELVDEATGEIIQIINKDFHKEPLYDLWHTIYSISDKSELASALEKKYGIKDENTVNKLYSIDFVKAGFGNKSAKAMRRILPYLQLGLKYSEACEYAGFNHSDSLTKQENLARTLMSKIPNIKKNELRQPVVEKILNQMINVVNTLLEEYGSIDEIRVELARELKQSKDERAATDKNMRARERENKSIVERIEEFNIRASRSRIQKYRMWTESNERCFYCGAPVSAKDFLSGLDVEIEHIIPKSLLFDDSFSNKVCACRACNAKKNNKTAYDFMKERGEKEFEEYLIRVESYYKDGKISKTKRDRLLTPADKIPSDFIERDLRLSQYISRKALEILKQVCYTVNSTTGSVTDFVRHVWGYDEVLHSLNFERYKNANLTELKEINHKGQTRTEERIIGWSKRLDHRHHAIDALVVAMTQQGFIQRLNNLNTERDAMFQEVEKQQDEWKHDYSLLQEWLREKPHFSVKEVSSSVDKILVSFKAGKRVASKGKRYVLKNGKRVVAQEDIIVPRGALNEESVYGKVHVMEFNKPLKYIFENSDLIVKPYIQKLVKQRIQEYHGDVKKAISSLKKSPIMIGKNKDVELQYATCFKEEVVIKYPLSSLKVKDVPSIVDKHIREIVEKRLKEHKGNEKVAFSTPLYSDKANTILINSVRCLTGLDAIVPVKYNDKGEAIGYAKPGNNHHIAIYRDGEGKLHEHLVTFWHAVERKKYNVPVIVKNTVEMWNDLSSKDLPESFLSHLPEYGWEFVESLQQNEMFVLGMSEDAYNDAVRNNDYSAINKYLYRVQKLRKGEYYFRFHVETQLDDTSAAKEMCKFYSIRSFGAFKALNPHKVKVSTIGKLII

SEQ ID NO: 7629 - protein, 1223 aa, unidentified
  REGION 1..1223: note = Description of Unknown:uncultivated organism sequence
MKKILGLDLGVASIGWAFLLEDEKNAENNQILDLGVRVIPLDTKTEKDEFAKGGNVGTNVKRRMYRGARRNLQRYRLRRTLLKNALTDLGLLPTDTELYYSAEQLYQLRDTALSSPVSLPELGRIFMMFNNRRGFKSTRKGEDKSESEYKEQIRLREENIRNAHQTPGQYFAKGLRTQQGFRVKQELFNRATYQAEFDEIWTKQAEFYPDLLTEKNKKRIRDRIIYYQRPLRSQKGLVGECALEWYYALEKETKAIKTDALGNRKVVRPKCAPKSSPLAQECRIWENIHNIRITNERGDDYPLSITEKKLLFDTLQNKKDITAAALLKLLKLTSGKYTLDALIREKGLEGNRTRVKLLEVFQKTGIQRRDILEFAPKVEEANAVDFETGNVFTRKQLVTHFDQEPLYQLWHLLYATEEESDLIALLQERYQFTEEQARALAQIDFTSAGFSNKSSRAMRRLLPHLQNGDDYTEACKKAGYNHSKSLTKEENAARLLAKSLLILPKNSLRNPVVEKILNQMIHLVNAILDDQRLGKPDEIRVELARELKQSAKERKKTFGNNNQRERERKDIRKKIAEMLKIDEQRVTKVQIEKWQLWHEVDGISLYTGKKTELASFLRGDGVDIEHIIPKSRCFDDSFENKTICETRFNQEKDKFTARDFMEAQPIAGLQSYEAYLRAINELERADKSRGVNGRGISKAKYNRLMMRAEDIPQDFLNRQLRETQYITKKARQILQDICHNVHSTSGTITDFLRNRWGWDEVIEQTRLEQFKMHGKTKTVMIRNGTQEKEVIEGWTKRLDHRHHALDALTVACTKQSIIKQLNTLNQTLENLKGEDRRDALRAHGQKNIASAQNAPFATAHVREAIENVLISFKQGANVASPSKNVIKKVVKQQTLTPRGPLHEETVYGQIKFYRTVNLDSRFKPEWLDLMVHPHQKELVMQRLTVHDNNIAKAFKGLAKDPILYGKGLEKSLKKVTIWDFTYVSRKDVAVLTDKQVEKIVDKSVQKSIQERIAGHKDIKEALKQVGIQPIFAGGPFAVKKVRVKNPAPQLIALPRGYVESSGNHHIAIYKDQDGKKHEMVVNFWEAFKRVKAGLPLIIKDVKGLSSAIEEGKISNLPDDLKLPDYNWEFVTSLQRNEMFVFNMTVEEVNYAILTGYNQLSKNLYRVMKISSKEYWFSHHLETENLVDQESKNLGRSKWCSISSLEGVIKVKVNRLGKIVNIIT

SEQ ID NO: 7630 - protein, 1223 aa, unidentified
  REGION 1..1223: note = Description of Unknown:uncultivated organism sequence
MKKILGLDLGIASIGWAFILEDEKNAENNQIIDLGVRVIPLDTKSEKDEFAKGGNVGTNVKRRMYRGARRNLQRYRLRRTLLKDGLTGLGMYPTDIELYYSAEQLYQLRDTALTDKVTLPELGRIFMMFNNRRGFKSTRKGEDKSESNFKEQIRQREENIRNAHQTPGQYFAHGLRTQKDFRVKQELFNRATYQAEFDLIWAKQASFYPEVLTEKNKKLIRDRIIYFQRPLRSQKGLVGECALEWYYALEKNTKAIITDALGNRKVIRPKCAPKSSPLAQECRIWENIHNIRITNERGDEYPLSITEKKLLFDTLQNKKDLSAAALLILLKLTPGKYTLDALIREKGLEGNKTRVKLLEVFQKAGIQRRDILEFAPAVEDANAIHFETGEAFSRKQLVAHFDQEPLYQLWHLIYATEEEQDLITLLQQRYQFTEEQAYAVAQIDFTSAGFSNKSSRAMRRLLPHLQNGDDYTEACKKARYNHSKSLTTEENAARLLAKSLQILPKNSLRNPVVEKILNQMIHLVNAILEDPRLGKPDEIRVELARELKQSAKERKNTFSNNNQRERDRKEIRKIIAETLKIDPQRVTKVQIEKWQLWHEVDGVSLYTGKRTELADFLNGNGVDIEHIIPKSRCFDDSFENKTICETRFNQEKGKFTARDFMESQPIAGLQSYEAYLRAINELERNNKSRGVKGPGISKAKYNRLMMRAEEIPQDFLKRQLRETQYITKKARQILQDICYQVNPTSGTITDFLRNRWGWDEVIEQTRIEQFRTHGKTKTILIRKDTQEKEVIEGWTKRLDHRHHALDALTVACTKQSVIQQLNSLNQTLENLKGEDRRDALRAHGQKNIASAQNAPFTTAEVRTVIENVLISFKQGSNVASPSKNTLKKGAVQHTLTPRGPLHEETVYGQIKFYRIVNLDGKFKPEWLDLMVHPHQKELVLQRLSTYDNNVAKAFKGLAKDPILYGKGLEKSLKKVTIWDFTYVSRKKVVELTDSQVEKIVDKSVQTAIQQRIAGYKDHKEALKQMGIQPVIVGGAFPVKKVRVKNPAPQLIAIPRGYVESSGNHHIAIYQDNEGKKHEMVVNFWEAFKRVKAGLPIVIKDVKGLYDAIEEGTITNLPDDLKLPEYDWTFVTSLQRNEYFIFNMKLDEIKLYMAKDYSKISKNLYRVMKLSSKEYWFSHHLETENLVDQESKILGRSKWCSISSLDGAIKVKVNRLGKIVNIIT

SEQ ID NO: 7631 - protein, 1164 aa, unidentified
  REGION 1..1164: note = Description of Unknown:uncultivated organism sequence
MATKKILGLDLGVGSIGWALIEMDDDIPSSILGMGSRIVPLTPDDSTQFSKGQAITKNADRTARRTARKGYDRYQLRRAKLTQVLRQNNMLPEHMDEHIIDLWQLRADAATEGKQLTLPQIGRVLYHINQKRGYKHAKADVSADSKQTKYVAEVNQRYKDIQERNQTIGQYFYQKLVESAVQAPSGPYYTFRIKDQVFPRAAYMAEFDQIMQTQKQFYPEVLTPELIDTLRNQIIFYQRPLKSCKHLVGLCEFEMKAYTNKATGKVVYSGPKCAPRTSPLAQLCAMWEAANNITLFNKSNEYLPITLVQRQAIVEHLNTHEKLTAKDLQKILGISPKEGWSAGKAVGKGIKGNMTFNQLRQALGGKYDHLLQMNMQMVDYVDEATGEVISRISEAIEQEPLYRLWHVVYSVQEREELGKALHKQFGIDDEAVVEALFKIDFVKPGYANKSHKFIRKLLPYLMKGYKYSEACDHIYVNHSNSMTKEQNATRELVDKIPLLLKNELRQPIIEKILNQMINIVNALKEQHGNIDEVRVELARELKQSKDERAHTTERINKNERENKAIEERIREHGIRPSRARIQKYKMWEESQHQCFYCGKSISAAEFLSGADVEVEHIIPKSILFDDSFSNKVCACRACNHAKGNMTAREFMETRSQAELEAYLSRVNAAFEEGRISKTKRDHLLWHKEEIPQDFIDRQLRQSQYISKKAVEILRSAIRDVYATSGSVTDFLRHIWGYDQILHQLNLPKYRDAELTEWVTYDHRGQEHQEERIKNWSKRIDHRHHAIDALTIALTRQGYIQRLNNLNASHDDMAEAVRKVNPLMEKKYSLLEKYIYIQPHFTVQEVTDKVDGILVSFRAGKKVTTPAKRAIYRKGKRINVQDGLLVPRGALTEETVYGKLGNKYVVKYPLTHPSMKVDDIVDPTIREIVRARLAAFSGKAKDAFAKPLYSDAAQKMEIKTVRCYTGLQDKAVASVRFNAQGEPIGFAKTGNNHHIAIYQDAKGQYQESVVSFWQAVERKRYGLPIVIEDPKAIWDKLIDSDLPQEFLSTLPQDDWQFVVSLQSNEMFILGMEDGDFEMAMQNKDYQLLNKYLYRVQKIRGKEYTFRYHVETTVDDKYSNEKGESKPNPALSMQMKKLISIRSFGGWLAQHPHKVRVNLLGEISEV

SEQ ID NO: 7632 - protein, 1158 aa, unidentified
  REGION 1..1158: note = Description of Unknown:uncultivated organism sequence
MATKKVLGLDLGVGSIGWALIELENDNPTSILGMGSRIVPLTTDDSTQFQKGQAITKNADRTQRRTARKGYDRYQMRRKNLTEVLRKHGMLPERTDEHIIDLWQLRADAATEGKQLTLPQIGRVLYHINQKRGYKHSKADVSADSKQTKYVAEVNQRYKNLLERNQTIGQYFCQMLKETAVMAASGLYYTFRIKDQVFPRAAYVAEFDQIMTAQKVYHPNVLTEELIHQLRNEIIFYQRPLKSCKHLVGLCEFEKKAYTNKAGQVVYDGPKCAPRTSPLAQLCAVWETVNNISLSNRKGEHLEITLAQRQAMVEWLCNNEKMTAKDLQKILSISPKEGWYAGKAVGKGIKGNSTLYQLRKALGKKYEELLKMDLPLVDVAIYESTGEVVQYVAEQVEQEPLYRLWHVVYSVQDEEQLRKALRKLGIEDEEVIDNLFKIDFVKPGYANKSHKFIRKILPYLMQGYHYSEACEHVGIKHSKSETKEENEVRELVAKIPLLMKNELRQPIIEKILNQMINIVNALKEKHGEIDEVRIELARELKQSKDERAHATERINKNERENKAIEEKIREFGIRPSRARIQKYKMWQESQERCFYCGKQIGAAEFLSGFDVEVEHIIPRSVLFDDSFSNKVCACRACNHTKGNMTARDFMATQGKDKLEEYLSRVDTAFKEGRISKTKRDHLLWSKEDIPQDFIDRQLRQSQYIAKKAAEILYPAFRHVYATSGSVTDFLRHIWGYDEILHQLNLAKYRDAEMTEVVTYDHRGQEHQEERIKNWSKRIDHRHHAIDALTIALTKQGYIQRLNSLSASHDEIEAAVREKNPVMDRKYSLLEKYIYIQPHFTVQEVTDAVDGILVSFRAGKKVTTPAKRAKYHNGKRVIVQDGLLVPRGALTEETVYGKLGDKYVVKYPLNHPSMKVDEIVDPTIREIVRARLAAFGGKAKDAFAKPLYSDAAQTMEIKSVRCYTGLQDRAVAAVRYNEQGEAVGYTKTGNNHHIAIYQDANGQYQELVVSFWQAVERKRYGLPIVIEDPKAVWDRVMDMDLPQAFLETLPKDNWQFVVSLQANEMFILGLEDGDFEMAMENKDYQLLNKHLYRVQKIGSKDYSFRYHIETSVDDKYDGVHNRALSLTMKKLISIRSFGSWFAQYPHKVRVNLLGEIAEV

SEQ ID NO: 7633 - protein, 1164 aa, unidentified
  REGION 1..1164: note = Description of Unknown:uncultivated organism sequence
MATKKILGLDLGVGSIGWALIEMEDDKASSILGMGSRIVPLTTDDSTQFSKGQAITKNADRTARRTARKGYDRYQLRRAKLTQVLRQYNMLPEHMDEHIIDLWQLRADAATEGKQLTLQQIGRVLYHINQKRGYKHAKADVSADSKQTKYVAAVNQRYKDLQDLNQTIGQYFYQQLVESAVQTPSGPYYTFRIKDKVFPRAAYVAEFDQIMQVQKVFYPEVLTAELINTLRNEIIFYQRPLKSCKHLVGLCEFEMKAYTNQHTGQVVYSGPKCAPRTSPLTQICAIWEAINNITLFNRRNEYLDITFDQRKAMVEHLCNNEKMTAKDLQNILGISSKEGWSVGKAVGKGLKGNMTLYQLRKALGKKYSHLLQFNLQMTDYVDEATGETISRIADAVEKEPLYRLWHVVYSVQDREELGKALLKQFGIDDEEVVEALFKIDFVKPGYANKSHKFIRKLLPYLMKGYKYSEACEHIGINHSNSITKEQNATRKLVNKIPLLLKNELRQPIIEKILNQMINIVNALKEQHGNIDEVRVELARKLKQSKDERAQATERINKNERENKTIEERIKEYGIRPSRARIQKYKMWQESQERCFYCNTGVSATEFLSGADVEVEHIIPRSVLFDDSFSNKVCACRACNHAKGNMTAREFMETRSQAELEAYLSRVNTAFEEGRISKTKRDHLLWHKEEIPQDFIDRQLRQSQYIAKKAVEILRTAIRDVYATSGSVTDFLRHIWGYDQILHQLNLPKYRDAELTEWVTYDHRGQEHQEERIKNWSKRIDHRHHAIDALTIALTRQGYIQRLNNLNASHDDMAEAVRKVNPLMERKYSLLEKYIYIQPHFSVQDVTNAVDGILVSFRAGKKVTTPAKRAIYRKGKRINVQTEIQVPRGALTEETVYGKVGDKYVVKYPLTHPSMKVDDIVDPTIREIVRTRLAAFGGKAKDAFAQPLYSDAAQKMEIKSVRCYTGLQDKAVAAVRFNAQGAAVGFSKTGNNHHIAIYQDKNGQYQESVVSFWQAVERKRYGLPIVIEDPKAEWDKVMDMDLPQEFLETLPKDDWQFVVSLQANEMFILGLEDGDFEMAMENRDYQLLNKHLYRVQKIRGKEYTFRYHIETTVDDKYTNENGEMKPNPALSMQMKKLISIRSFGGWLAQHPHKVRVNLLGEISEA

SEQ ID NO: 7634 - protein, 1158 aa, unidentified
  REGION 1..1158: note = Description of Unknown:uncultivated organism sequence
MSTKKILGLDLGVGSIGWALIEIENDKPKQILGMGSRIVPLTKDDSDQFQKGQAITKNADRTQKRTMRKGFDRFQLRRAYLTKILQANSMLPENGSKLWTLQSVALWQLRADAACKEIDLKELGRVLYHLNQKRGYKHAKADVSGDSKQTAYVATVNQRYADLQKTGLTIGQYMYEQLKASEVVGDNGVYYTFRVKDKVYPRGAYVEEYDRIMAEQKKHHPEVLTDELIDELRNRVIFYQRPLKSCKHLVSLCEFEMRPIKTKDGRIVYKGPKVAPRTSPLSQLCAIWETVNNIKLTNRKNEEYPMTLAERQDLVNHLMTNEKLTLTQLQKILGITKRDGWYGGKAIGKGLTGNKMLCDLTKALGGKYDQWLQFNLPTEHGNIVDVETGEIYDVISEQIEQEPLQQLWHTLYSISDKEELREALRKRFDITDEEVVDALFALDFVKPGYANKSTKFMRKELPLLMQGYMYSEVCALLGINHSASLTKEQNDARELKPRLAQLQKNELRQPVVEKILNQMINVVNALKDEYGEIDCMRVELARELKQSLSEREETYRAINRNEKKNAEYAAKIKELGVRPSRSRVQKYHLWLESNHSCFYCGKQVNAAEFLSGADVEVEHIIPRSVLFDDSFSNKVCACRQCNQEKGNLTAMDYIKTKSQEVQDAYLRRVEEAYASKNEETHISKTKRDHLLWTLNDIPQDFIDRQLRQSQYIAKKAVEILNETCHEVNATSGQVTDFLRHLWGYDEVLHDLNRPVFEKVGLTELKDGHERIKGWTKRMDHRHHAIDALTIALTRQSYIQRLNTLNASRDEMYAEVEAADTEYKEKRSLLEKWVMLQPHFTTEQVAEKADGILISFRAGKRVTTPAKRAIYVGGKRQNVQTGLQVPRGALTEETIYGKTDGRFVVKYPLDHPSMKPEEIVDPTIRQIVMDRLSAFGGNAKKAFATPLYSDKAQTMQIRSVRCFTRLQENSMTIVKRDEHGQPIGYAKLGNNHHIALYKDKEGQMHEQVVTFMQAVMRKQAGLPIVITDPKAVWTGLMDRDDVVDEVLKMLPEDSWTYVVSMQANEMFILGLTDSEFVTAMQEKDYRMLNKHLYRVQKLASSDYYFRYHLETSVDDKYNGEKNEKLSLEMQKVMRVRSFSSLSNLNPIKVRINVLGEISL

SEQ ID NO: 7635 - protein, 1229 aa, unidentified
  REGION 1..1229: note = Description of Unknown:uncultivated organism sequence
MKNVLGLDLGVGSIGWCLVQKEDDGSPISILKMGSRIVPLTSDEENEFTKGNAISKNMARTQMRTTRKCYDRYQLRRYALCNILKSSGMLPDATLNALSPLQIWQLRADAATEGHKLELIEIGRVLLHINQKRGYKHSRIQNGDAKETAYVKEVNARYKLLVEEGKTVGQHFACEMANSEDETPKGKKHYTYRIKDQVFPRIAYEEEVKQILSVQSLYYPEILTDSKQKEIFDIMFFQRDLKSCKYLISGCEIEKHTIVKDGKEITIAPKVAPKTSPIAQLSKILESANNITIKNRKNEELYITIEQRDAIATFLDTHEVLKLQDLYKILNISKKDGWWAGKAIGRGLQGNTTRMQLIEALKTMPKEKVEALTRFEVSVVDMADKETGEVFQIVDKKIAKEPLYILWHMIYSIKDKDELASALRKHGITDETAIERLCTLNFTNAGYSNKSVKATRRILPYLMKGYKYSEACEQAGFRHSDYLTKEENENRVLKSKLANLQKNELRQPVVEKVLNQMINIVNSLLESTEGPIDEIRVELARELKQSKEERNESDKRNRTNEKENSDIAKKLKEQGFVPTRNRIQKYKMWEESEHCCMYCGQPVNLSEFLSGADYEVEHVIPRGLLFDNSLTNKVCSHRSCNQAKGMRTGYDYMHDDKSEKEFNDYIDRVNDLCSRGKISRSKRDRLLTSYNDYLARKAQCKETEEDKNLWENFIERQLRQSQYIATKAVEILKQVCRDVYTTSGSVTDFVRHVWGYDEVLHNLNLPRFQLAGLTEMVTSNNSGVEVTRERITNWTKRIDNRHHAVDALTIACTSQSVIQRLNRLNATREIMMSEVQEANREWNEKRSLLEKWLSIQPHLSHAVVSEAVSKILISVKSGKKATTSGKRYVWKNGKRLLVQTGILVPRASLHDQYVYGGIKRYVKTKNGVAQERQILMKYKLAIGAQGCLFTGNETYKEEIKKDKKTGLETVIVKDKIQDVLNKVVDKRIQTLILERINRGFEAGKDYRSDVKKALANLKNLEDEPIYFDDNHTMPIRTVKKFTNSNTAVPIRFHENGEPYAYVEPGNNHHVALYAKPDGTIEERIYTLWQVVERKRYGIPTIIKNPQKVWDDLANTDVDIPEEILNTLPEASSRFLESLQINDMFILGMEEDEYERAIKGKDYTTLGEYLYRVQNLSASQYRFRRHTESKFDTNDMNKADKRFYNIQSLDSLFKLNPHKISINIQGDIMN

SEQ ID NO: 7636 - protein, 1154 aa, unidentified
  REGION 1..1154: note = Description of Unknown:uncultivated organism sequence
MEKKILGLDLGVGSIGWALISTENDQPKQILGMGSRIVPLTKDDSDQFQKGQAITKNAERTQRRTARKGYDRYQLRRALLTQWLRQHNMLPERMDEHVIDLWKLRADAATDGCQLTLPEIGRVLYHINQKRGYKHAKADAGDSKQTKYVETVNQRYRELQAEHLTIGQHFYQELLKSCVHAEKGDYYTYRIKDQVFPRQAYIEEFDRIMKVQKSFYPKVLTDEVIADLRNRIIFYQRPLKSCKHLVSLCEYEMRPYKTKDGKIVYSGPKVAPRTSPLAELCAIWETANNLTLTNRNNERYEFTLQQRQQIVNHLLTHEKLTLTDLYKILGFSKKDGWYGGKAIGKGLKGATSMLSLRKALGDKYDTEKYLAFDIHTLDTDLVDVTTGEVIQIVDAKIEEQPLYRLWHIVYSIQDKDELRKALKNQMNIDDEEVVENLFALDFVKPGYANKSHKFIRRILPYLMQGYMYSEACAQVGINHSGYMTKEENTERPLLKHMPLLQKNELRQPIVEKILNQMINIVNALTDRYGAIEEVRVELARELKMSKDERADADKRNRDNEKLNTKLAEKIAEMGIRATRSRIQKYKMWEESDHQCFYCGKQIGLAEFLSGADVEVEHIIPRSVLFDDSFSNKVCACRECNREKGNLTGFDFVAGKGAAELEAYKTRVEEAQKTGRISRTKRDHLMWRQEDIPQDFIDRQLRQSQYISRKAVELLQQVCRNVYASSGSVTDFLRHQWGYDEILHTLNFPRYAAAGLTYVRESDNKERIADWSKRIDHRHHAVDALTIALTRQGYIQRLNTLNASRDEMFAEVQQSDAHYSEKRSLLEKWIQFQPHFPTAEVLKEVDGILVSFRAGKKVTTPAKRVVYKKGKKVVMQEGVLVPRGALSEETVYGKLGDKYVVKYPLDHPSMKVDDIVDPTIQAIVRARLEAFGGKAKEAFVKPLYSDAAQTMEIRSVRCYTGLQDKSVAPVRFNAKGEAIAFAKMGNNHHIAIYRDKDGKYQESVVSFWDAVERKRYGLPVVIEQPAEVWNKAMDVELPEDMLEKLPKDGWQFVTSMQVNEMFILGMPEADYHEAMLKGDYQALNKYLYRVQKISSKDYYFRYHTETTVDDKYNGTVNPNLSVEMKKMLRLRNISALDAQNPHKVKVNILGEITEL

SEQ ID NO: 7637 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFDITDECVLDNLSSIDFVKDGYANKSHKYIRKILPQLQKGVMYAHACEIVGSSNCSDYKATKRANNGALLLSPIAKGELRQPVVEKVLNQMVNVVNALIEKYGEFEEIRVELARDLKQNREERNEDYRRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGIDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPKIKQTGILVPRGELTEETVYGLIQRYDGKEGFKTCSVVRYPLSKITSQADANSIVDEGIKQIVKKRLKEHNDNAKIAFSTPLYSDVAQTKEIKGVRCFSGHKRASLAIVKRDENGKPIGFSPTGNNHNVAFYLNENGKPVELVCSFYHAIQRRLFNIPTIIENPSELWDLIETSGKEFSEEFLSQLPKPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 7638 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGNTTRIKIEKALNGKYPHLLKFNIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYRRITTQNKKNLEIAERIQQEYKLYPTKARIRKYRMWEETEHRCIYCGAPVSIKEFLSGIDAEKEHIIPRSLLFNDSFSNTTCACRSCNHDKGQMTGIDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSYIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFKTCSVVRYPLSKITSQADANSIVDEGIKQIVKKRLKEHNDNAKIAFSTPLYSDVAQTKEIKGVRCFSGHKRASLAIVKRDENGKPIGFSPIGNNHNVAFYLNENGKPVELVCSFYHAIQRRLFNIPTIIENPSEVWDLIETSGKEYSEEFLSQLPKPKWTFAFSLQKNEMAIIGSTKNDFEYALQNGDKKTLAQHLYKVQSISPNYYCFTRHTETKYDKNHVNKPDDRFLRYRSVPSLMQDIAAKVSINVIGDILKK

SEQ ID NO: 7639 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESRGKAFFDDYINRINKLTDKKEISRSKFKNLTTKREDIPQDFIERQLRETQYISRKAVEMLQSLYADKPSGKLYVKTSGGIVTDFLRHQWGWDTVLHQSNFKRFEKAGLIENVPVITNGEKHLEKRIIGWNKRIDNRHHAIDALTVACTQQNHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNPKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7640 - protein, 1157 aa, unidentified
  REGION 1..1157: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGYTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKND

SEQ ID NO: 7641 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGVTIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDEYVLDNLSSIDFVKEGYANKSHKYMRKILPQLQKGVMYAHACEIVGSSNCSDYTATKRANNGALLLSPIAKGELRQPVVEKVLNQMVNVVNALIEKYGEFEEIRVELARNLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRRCNHDKGQMTGFDYAESRGKAFFDDYINRINKLADKKEISRSKFKNLTTKREDIPQDFIERQLRETQYISRKAVEMLQSLYADKPSGKLYVKTSGGIVTDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPKIKQTGILVPRGELTEETVYGLIQRYEGKGGFKTCSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIENPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 7642 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTNNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKHIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDEYVLDNLSSIDFVKEGYANKSHKYMRKILPQLQKGVMYAHACEIVGSSNCSDYTATKRANNGALLLSPIAKGELRQPVVEKVLNQMVNVVNALIEKYGEFEEIRVELARDLKQNREERNEDFRRMTTQNKKNLEIAERIQQEYKLYPTKARIRKYRMWEETEHRCIYCGAPVSIKEFLSGIDAEKEHIIPRSLLFNDSFSNTTCACRRCNHDKGQMTGIDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFKTCSVVRYPLSKITSQADANSIVDVGIKQIVKKRLKEHNDNAKIAFSTPLYSDVAQTKEIKGVRCFSGHKRASLAIVKRDENGKPIGFSPTGNNHNVAFYLNENGKPVELVCSFYHAIQRRLFNIPTIIENPSEVWDLIETSGKEFSEEFLSQLPKPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7643 - protein, 1158 aa, unidentified
  REGION 1..1158: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDFRRMTTQNKKNLEIAERIQQEYKLYPTKARIRKYRMWEETEHRCIYCGAPVSIKEFLSGIDAEKEHIIPRSLLFNDSFSNTTCACRRCNHDKGQMTGFDYAESRGKAFFDDYINRINKLADKKRDGISRSKFKNLTTKREDIPQDFIERQLRETQYISRKAVEMLQSLYADKPSGKLYVKTSGGIVTDFLRHQWGWDTVLHQSNFKRFEKAGLIENVPVITKGEKHFEKRIIGWNKRIDNRHHAIDALTVACTQQNHIQRLNTLNANKEAFTKLDATTNEGYRAFIKRVAQEAPFTTAEVLEAADNIIVSFKPITKSTTPGKRKVFKNGKPKIKQTGILVPRGELTEETVYGLIQRYDGKGGFKTCSVVRYPLSKITSQADANSIVDEGIKQIVKKRLKEHNDNAKIAFSTPLYSDVAQTKEIKGVRCFSGHKRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIEK

SEQ ID NO: 7644 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEDIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTAACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKCDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIKK

SEQ ID NO: 7645 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDEYVLDNLSSIDFVKEGYANKSHKYMRKILPQLQKGVMYAHACEIVGSSNCSDYTATKRANNGALLLSPIAKGELRQPVVEKVLNQMVNVVNALIEKYGEFEEIRVELARDLKQNREERNEDFRRMTTQNKKNLEIAERIQQEYKLYPTKARIRKYRMWEETEHRCIYCGAPVSIKEFLSGIDAEKEHIIPRSLLFNDSFSNTTCACRRCNHDKGQMTGFDYAESRGKAFYDDYINRINKLADKKEISRSKFKNLTTKREDIPQDFIERQLRETQYISRKAVEMLQSLYADKPSGKLYVKTSGGIVTDFLRHQWGWDTVLHQSNFKRFEKAGLIENVPVITKGEKHFEKRIIGWNKRIDNRHHAIDALTVPCTQQSHIQRLNTLNANKEAFTKLDATTNEGYRAFIKRVAQEAPFTTAEVLEAADNIIVSFKPITKSTTPGKRKVFKNGKPKIKQTGILVPRGELTEETVYGLIQRYDGKGGFNACSVVRYPLSKITSQAVADSIVDEGIKQIVKKRLKEHNDNPKIAFSTPLYSDTAQTKEIKGVRCFSGHKRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIEK

SEQ ID NO: 7646 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIVGSSNCSDYKASKRANNGALLLSPIAKGELRQPIVEKVLNQMVNVVNALIEKYGEFEEIRVELARDLKQNREERNEDYRRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGIDYAESRGKAFFDDYINRINKLADKKEISRSKFKNLTTKREDIPQDFIERQLRETQYISRKAVEMLQSLYADKPSGKLYVKTSGGIVTDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPKIKQTGILVPRGELTEETVYGLIQRYEGKGGFKTCSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIENPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIEK

SEQ ID NO: 7647 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERKEDYRRITTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHLEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPKIKQTGILVPRGELTEETVYGLIQRYDGKDGFKTCSVVRYPLSKITSQADANSIVDEGIKQIVKKRLKEHNDNAKIAFSTPLYSDVAQTKEIKGVRCFSGHKRASLAIVKRDENGKPIGFSPTGNNHNVAFYLNENGKPVELLCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNSYCFTRHTETKYDKNHVNKPDDRFLRYRSVPSLMQDIAAKVSINVIGDIIKK

SEQ ID NO: 7648 - protein, 1158 aa, unidentified
  REGION 1..1158: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGVTIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIVGSSNCSDYKASKRANNGALLLSPIAKGELRQPIVEKVLNQMVNVVNALIEKYGEFEEIRVELARDLKQNREERNEDYRRMTTQNKKNLEIAERIQQEYKLYPTKARIRKYRMWEETEHRCIYCGALVSIKEFLSGIDAEKEHIIPRSLLFNDSFSNTTCACRRCNHDKGQMTGFDYAESRGKAFFDDYINRINKLADKKRDGISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFKTCSVVRYPLSKITSQAVADSIVDEGIKQIVKKRLKEHNDNAKIAFSTPLYSDTAQTKEIKGVRCRSGHKRASLAIVKRDENGKPIGFSPTGNNHHAAFYLNENGKPVELVCSFYHAIQRRLFNIPTIIENPSEVWDLIETSGKEFSEEFLSQLPNPKWTFAFSLQKNEMAIIGLTKNDFEYALQNGDKKTIAQHLYKVQSFSHNDYCFTRHTETKYDKNHANKPDERFLRYKSASSLWRDFTAKVSINVIGDIIEK

SEQ ID NO: 7649 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHKRASLAIVKRDENGKPIGFSPTGNNHNVAFYLNENGKPVELVCSFYHAIQRRLFNIPTIIENPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7650 - protein, 1158 aa, unidentified
  REGION 1..1158: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIIGSSNCSDYKATKRANNGALLLSPIAKGELRQPVVEKVLNQMVNVVNALIEKYGEFEETRVELARNLKQNREERNEDYKRMTTQNKKNLEIAERIQQEYKLYPTKARIRKYRMWEETEHRCIYCGAPVNIKEFLSGIDAEKEHIIPRSLLFNDSFSNTTCACRRCNHDKGQMTGFDYAESRGKAFFDDYINRINKLADKKRDGISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPKIKQTGILVPRGELTEETVYGLIQRYDGKGGFKTCSVVRYPLSKITSQADANSIVDEGIKQIVKKRLKEHNDNAKIAFSTPLYSDVAQTKEIKGVRCFSGHKRASLAIVKRDENGKPIGFSPTGNNHNVAFYLNENGKPVELVCSFYHAIQRRLFNIPTIIENPSEVWDLIETSGKEFSEEFLSQLPKPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7651 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCKTLTDNDMNPTHKLMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLTQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDECVLDNLSSIDFVKEGYANKSHKYMRKILPQLQKGVMYAHACEIVGSSNCSNYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEIHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 7652 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTKKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYRRMTTQNKKNLEIAERIQQEYKLYPTKARIRKYRMWEETEHRCIYCGAPVSIKEFLSGIDSEKEHIIPRSLLFNDSFSNTTCACRSCNHDKGQMTGIDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNPKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQRNEMVIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7653 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHKIKVADGRIVISGPKTAPKSSPLAQVCKVWEFINNIVLCNKKGDTFSISDEQRMAISQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYRRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGIDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNPKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIEK

SEQ ID NO: 7654 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCFSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7655 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDHRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCFSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7656 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEDIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDSLTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKCDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIKK

SEQ ID NO: 7657 - protein, 1157 aa, unidentified
  REGION 1..1157: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYIRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGIDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNPKIAFSTPLYSDTAQTKEIKGVRCRSGHPRASLAIVKRDENGKPIGFSPTGNNHNVAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKND

SEQ ID NO: 7658 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCRSGHPRASLAIVKRDENGKPIGFSPTGNNHNVAFYLNENGKPVELVCSFYHAIQRRLFNIPTIIEKPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 7659 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIKK

SEQ ID NO: 7660 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEIHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCFSGHKRASLAIVKRDENGKPIGFSPTGNNHNVAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7661 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYRRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHKRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNDYCFTRHTETKYDKNHVNKPDDRFLRYRSVPSLMQDIAAKVSINVIGDIIKK

SEQ ID NO: 7662 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNDASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHSEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNPKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7663 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAESIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHKRASLAIVKRDENGKPIGFSPTGNNHNVAFYLNENGKPVELVCSFYHAIQRRLFNIPTIIEKPSEVWDLIETSGKEFSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 7664 - protein, 1157 aa, unidentified
  REGION 1..1157: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAESIQQEYKLYPTKARIRKYRMWEETEHRCIYCGAPVSIKEFLSGIDAEKEHIIPRSLLFNDSFSNTTCACRSCNHDKGQMTGFDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCRSGHPRASLAIVKRDENGKPIGFSPTGNNHHAAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISPNYYCFTRHTETKYDKNHVNKPDDRFLRYRSVPSLMQDIAAKVSINVIGDIIKND

SEQ ID NO: 7665 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAESIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIEK

SEQ ID NO: 7666 - protein, 1157 aa, unidentified
  REGION 1..1157: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSNYKATKRANNGALLLSPIAKGELRQPVVEKVLNQMVNVVNALIEKYGEFEEIRVELARDLKQNREERNEDYKRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESRGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKND

SEQ ID NO: 7667 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAESIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 7668 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSNYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNDYCFTRHTETKYDKKHTNKADERFMRYASASSLLRDFTAKVSINVIGDIIEK

SEQ ID NO: 7669 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 7670 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYRRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTPAQHLYKVQSISHNSYCSTRHTETKYDKKHTNKADERFMRYASASSLLRDFTAKVSINVIGDIIEK

SEQ ID NO: 7671 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRMQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSNYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNDYCFTRHTETKYDKKHTNKADERFMRYASASSLLRDFTAKVSINVIGDIIEK

SEQ ID NO: 7672 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAMRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHKRASLAIVKRDENGKPIGFSPTGNNHHAAFYLNENGKPVELVCSFYHAIQRRLFNIPTILEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7673 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNDYCFTRHTETKYDKKHTNKADERFMRYASASSLLRDFTAKVSINVIGDIIEK

SEQ ID NO: 7674 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHSEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 7675 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIEK

SEQ ID NO: 7676 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYRRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 7677 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAESIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIEKPSEVWDLIETSGKEFSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 7678 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTTGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHKRASLAIVKRDENGKPIGFSPTGNNHNVAFYLNENGKPVELVCSFYHAIQRRLFNIPTIIEKPSEVWDLIETSGKEFSEEFLSQLPNPKWTFAFSLQRNEMVIIGLTKNDFEYALQNDDKKTLAQHLYKVQSISHNSYCFTRHNETKYDKKHTNKDDERFMRYASASSLLRDFTAKVSINVIGDIIEK

SEQ ID NO: 7679 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKDPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKKLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCFSGHKRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNDYCFTRHTETKYDKKHTNKADERFMRYASASSLLRDFTAKVSINVIGDIIKK

SEQ ID NO: 7680 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELFKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKTIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKRDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 7681 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 7682 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCKTLTDNDMNPTHKLMCASKEELWKMRSDAATQQISLKEIGRVLYHINQKRGFKLAKNEASSTDTTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLTQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7683 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHKLMCASKEELWKMRSDAATQQISLKEIGRVLYHINQKRGFKLAKNEASSTDTTEQTYIQSINQRCAAIAGITIGQYIYSELFKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIENPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7684 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCKTLTDNDMNPTHKLMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLTQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 7685 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFDITDECVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7686 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHSEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNPKIAFSTPLYSDTAQTKEIKGVRCRSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7687 - protein, 1178 aa, unidentified
  REGION 1..1178: note = Description of Unknown:uncultivated organism sequence
MNKCAIISFFSVNLGKISKTTIMNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDTTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDVAQTKEIKGVRCFSGHKRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKNHVNKPDDRFLRYRSVPSLMQDIAAKVSINVIGDIIKK

SEQ ID NO: 7688 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSNYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 7689 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFNIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEIHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCFSGHKRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKNHVNKPDDRFLRYRSVPSLMQDIAAKVSINVIGDIIKK

SEQ ID NO: 7690 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYSELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYRRMTTQNKKNLEIAKRIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHPRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIEK

SEQ ID NO: 7691 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCETLTDNDMNPTHELMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLAQVCKVWESINNIVLCNKKGDTFSISDEQRMAIFQFMERNEKLKVTNLYKILGISKKDGWWGGKAIGTGLQGDTTRIKIEKALNGTYPHLLKFDIDNSGKCVNKDTGEELPCVKDTAFNEPLFKLWHTLYSICDIEELKAALRKNFDITDECVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQADANSIVDEGIKQIVKKRLKEHNDNAKIAFSTPLYSDTAQTKEIKGVRCFSGHKRASLAIVKRDENGKPIGFSPTGNNHNVAFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 7692 - protein, 884 aa, unidentified
  REGION 1..884: note = Description of Unknown:uncultivated organism sequence
MWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDVAQTKEIKGVRCFSGHKRASLAIVKRDENGKPIGFSPTGNNHHAAFYLNENGKPVELVCSFYHAIQRRLFNIPTIIEKPSEVWDLIETSGKEFSEEFLSQLPNPKWTFAFSLQKNEMAIIGLTKNDFEYALQNDDKKTLAQHLYKVQSISPNYYCFTRHTETKYDKNHVNKPDDRFLRYRSVPSLMQDIAAKVSINVIGDIIKK

SEQ ID NO: 7693 - protein, 1156 aa, unidentified
  REGION 1..1156: note = Description of Unknown:uncultivated organism sequence
MNYFLGLDLGSGSIGWAVIEKQNGIPVRIIALGSRIVPLTPNESDNFSQGKAVSINQQRTQKRTARKTLDRYQMRRALLCKTLTDNDMNPTHKLMCASKEELWKMRSDAATQQISLKEIGRVLYHINQKRGFKLAKNEASSTDKTEQTYIQSINQRCAAIAGITIGQYIYGELIKNPEFRYRQLVYSREKYIEEYDTIMKCQQQFYPDVLTDELISKIRNEIIFYQRKLKSCKHLVSYCNMELHEIKVADGRIVISGPKTAPKSSPLTQVCKVWESINNIVLCNKKGDTFSISDEQRMAIFQFMERNEKLKVTNLYKILGISKKDGWWGGKAIGTGLQGDTTRIKIEKALNGKYPHLLKFDIDNSGKCVNKDTGEELPCVKDTAFNEPLFKLWHTLYSISDIEELKAALRKNFNITDEYVLDNLSSIDFVKEGYANKSHKYMRKILPQLQKGVMYAHACEIVGSSNCSDYKATKRANNGALLLSPIAKGELRQPVVEKVLNQMVNVVNALIEKYGEFEEIRVELARDLKQNREERNEDYKRMTTQNKKNLEIAERIQQEYKLYPTKARIRKYRMWEETEHRCIYCGAPVSIKEFLSGIDAEKEHIIPRSLLFNDSFSNTTCACRSCNHDKGQMTGFDYAESKGKAFFDDYINRINKLADKKEISRSKFKNLTTKREDIPQDFIERQLRETQYISRKAVEMLQSLYADKPSGKLYVKTSGGIITDFLRHQWGWDTVLHQSNFKRFEKAGLIENVPVITKGEKHFEKRIIGWNKRIDNRHHAIDALTVACTQQSHIQRLNTLNANKEAFTKLDATTNEGYRAFIKRVAQEAPFTTAEVLEAADNIIVSFKPITKSTTPGKRKVFKNGKPIIKQTGILVPRGELTEETVYGLIQRYDGKGGFNACSVVRYPLSKITSQAVADSIVDEGIKQIVKKRLKEHNDNAKIAFSTPLYSDTAQTKEIKGVRCRSGHPRASLSIVKRDENGKPIGFSPTGNNHNVAFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 7694 - protein, 1256 aa, unidentified
  REGION 1..1256: note = Description of Unknown:uncultivated organism sequence
MKKILGLDLGTTSIGWALINVDENNNPNDIQNMGVRIVPLSENEGDKFTKGLDITINADRTRARGARRNYDRYQLRRQALTDKMRQLDMLPDEHLIKLPMMELWQLRANAVTKKISLNELGRILYHLNQKRGYEHSRTDANDSKQREYVKEINNRYAQLQKSKMTIGQFFAKKLAETAIVQDGKISYNFRIKDQIYPRSAYKEEYDAIMKCQQRFYPNILTDSIIDEIRNRIIYYQRELRSCKHLVSVCEFEKRCFYDADGKVKRNKKDEIVYDGPKVAPRTSPLFQVFKDWQSINNLRFHNRRNEYLYITREQKEQIAAYMDNHEILKLKDVQSLLDITSKSGWYCDKAIKAGIKGNSTRCAILSSLSSLTHSKIAEITRFNLETEPTNIVDEETGEMLVRIRNTYQDEPLYRLWHIIYSIKNDNERVNAISKFLKEFEVEDETIINSLKNIDFVTPGYANLSAKAICKILPYMMEGLDYSDSCEYAGYNHSNSLTKEENEKRQLLDKIPALKKNELRQPTVEKILNQTINVFNQINEDLSKDGERISEVRVELARELKQSKEERNEAEIGIRKQQKLNDEYAKILKEEGVRPTRNRILKYRLWRESNKSCFYCEQPISFHEFLDFSETEREHIIPKKLMYDDSFANQVCSCRKCNKEKGGRTAMDYMRTKPNLQFYLDKVDKMFQDHKISGKKHSHLLASYDDYLIRKENGKETKDDILIWEKPIERQLRLSQYISRKAQELLRMACRDVTATTGEITALIRHTWGYDTILHDLNFSSYKKVGLTELVKDEDSGRTREIIKDWSKRLDHRHHAIDALAVACTSRSIVQRINTLNASREEIRGEIKAPRKDWKDSNLLQQWIKEKMPFDRQYVLHKVASILISMKAGKKATVPGKRKIYKKGKPIVIQTGLRIPRGQLHEQTVYGAITQYEKGQKVLKIVTRYKMGVGSMGYVFNGKETCDVIKKNEHYEIVDGIQKALDYIVDGHIREVVKARINEAFPEGETYLTEAEEALAEGRTYDGKARCQKALDQLRTLSEKPLYADKGKHITIKSVRCFTGLNAVQPLRRNDDGEPISYVLTKNNHHVAIYVDEKGEPKECIYTFWQMVERSKYKLPLIIKNPKTLWEEILQREKDGEKFPDSLIQSLPPSNWTFIESLQLNDMFIMDMDNDDYNRNIDTNNYEELSKKLYRIQNISSGDYFLRLHTDTTTDRNNAKLTKKFLRKSLTGFLSSNPHKVQISLLGKIIRNSNDQKDPMF

SEQ ID NO: 7695 - protein, 1249 aa, unidentified
  REGION 1..1249: note = Description of Unknown:uncultivated organism sequence
MKNILGLDLGTASVGWALIKADDNNNPIEIQDMGVRIVPLAENEGDKFTKGQDITVNADRTRARGARRNYDRYQLRRQLLTEKMRSLNMLPDERLIKLPIMELWQLRANAVTQKVTLNELGRVLYHLNQKRGYKHSRTDVNDSKLREYVKEINNRYSQLQELGMTIGQFFACKLSETAVSQNGKTFYVFRIKDQIYPRKAYEEEFDAIMNCQQSFYPEILTNDVIDEIRNRIIYYQRDLRSCKHLVSVCEFEKRCFYDADGNVKRNNKGDIIYDGPKVAPRTSPLFQVFKNWQSINNLRFHNRNNESLYITKEQKHQIAVYMDNHELLRLKDVQGILDITPKSGWYCDKAIKAGIKGNTTKHAILSALTSLPLSKIQEITRFNLETEATNIADEETGELLVRIKPTYQEEPLYRLWHIIYSIKNDDERENSIIEFLKEFNIEDGTIVNALKDIDFVTPGYASISAKAISKILPYLMDGLDYSDSCEYVGYNHSNSLTKEENLERELLDQIPALKKNELRQPTVEKILNQTINVFNQINNSLIIKGERIDEVRIELARELKQSKDERRDAEIGIRKQQKKNDEFANILRGEGIRPTRNRILKYRLWREANETCFYCEKPINFKEFLKFSDIEREHIIPKKLMLDDSFANQVCSCRRCNEEKGGRTAFDYMRTTQNLQFFLDKVDKMFQDNKISAKKHSHLLASYDDYLIRKKEGKETKEDVNIWEKAIDRQLRLSQFISRKAHELLKKACRDVTATSGEITYLLRHIWGYDTILHELNFTSYKEAGLSDFITDEKTGKQKEVIKDWAKRLDHRHHAIDALAVACTSRSIVQRINTLFAYNEEIRKEIKSPRKEWKDNNLLQQWIKEKLPFDRQYVLHKVASILISMKAGKKVTVPGKRKIYKNGKPCIVQTGLKIPRGQLHEQTVYGAIKLFEKDKGIVTEIVTRYKMGVGSMGYVFNGKETCDVIYNNKKKCYEMLDGIEKAISYIVDKHIRDIVRKRLNEAFPEGQTYRSEAEKALAECKVYDGRARCQKALEQLRSLNENPLYADKNKKIVIKSVRCKTGLSAVQPLRRNSNNDPISYVLTKNNHHVAIYADEKREYKECIYTFWQAVERSKYRLPLIIKDPKVVWEEIYKRENDGETFPDSLIQSLPLPNWTFVESLQLNDMFIMDMDDDDFERNIVTNNYEELGKKLYRIQTISTGDYFLRLHTDTTTDRINSKLTKKFLRKSLMSFVSSNPHKVQISLLGKIIR

SEQ ID NO: 7696 - protein, 1217 aa, unidentified
  REGION 1..1217: note = Description of Unknown:uncultivated organism sequence
MKKILGLDLGVGSIGWCLIQTDNDGNPQAILGIGSRIVPLSTDDTNEFSSGNAISKNQKRTQKRTIRKGYDRFQLRRQYLTEELRKLGMLPDEALIKLPVLKLWQLRADAATPGKKLSLPEIGRVLYHINQKRGYRHSKNDEGEDKSQREYVQAINDRFATIKAEQKTIGQFFAQKLSASAITTDKGQFYTFRTKDQVFPRKAYEEEFDQIIACQRVYYPKLLTDQTIRRLRDEIIFYQRPLKSCKHLISRCEFSLREYKTADGKSIISGPKVAPRSSPLFQVCKIWESVNNIELKNRNGESYPFTAKERQVLFDFLDNNEKLTVTDLKKILGLSVKEKWWGGKAIGKGIQGNITKVALKKALQGHEDLLSFQLKSAGSHFIDTETGEILQEITPEFEKEPLYRLWHIVYSIEDPAEMAAALYHQFGIQDPNIITRLTKIDFVQPGYGNKSARFIRQILPYLQKGMKYSEACDYININHSNSLTKAENNARELLPYMTPLQKNDLHQPVIEKILNQMVNIVNALLDKHGSFDEVRVELARELKQSRDERNHAYLDNNKRERENKVIEARIREMGIRTSRTRVQKYRLWEEAKHICFYCGQPVGVKEFLQGADVEIEHIIPRSLFFDDSFSNKVCACRKCNAEKGNRTAYDYMLQKGQNEFQDFTRRIEEAFERKEISKTKRERLMTTADDIPVDFIERQLRQSQYIAKKAVEMLKQVCRNVWTTSGSVTDFIRHQWGYDKILHELNFERYDFAGQTEIITYDHRGQIHQEKRIKGWTKRLDHRHHAIDALTIASTKQSYIQRLNHLNASRDKMFSELESQTDEVKEKYSLLEKWMRERPHLPTDKVMEAVDGILVSFKAGKRVSTLGKRYTYKNGKRTIAQSGIVVPRGALSEESIYGAISCLEDNVPLKVIFEKPESIFKPYIKEKVEERINEHNGDWKAALKSLKKKPIYLGDNETKPLEYATCWKKEFVIRYPLINIKKKDVDYIVDSHIRQIVAERIEAVGEKEAFKEPLYADKAGTIPIKSIRMFTKLNEKSVAPVKYEGCTPVGFVKLGNNHHIALYRDASGNLSEHVVSFWNAVERKKYGIPVIIEDTAVLWNQMAKKNLPEHFLNSLPPAGLKLETSLQQNEMFILGMPEEDYQRAIREKDYKQLNKYLYRVQKIATQDYYFRFHVETVLDDSAEALSSKKYYRTRIGAFMKLNPHKVLVNLLGEIAEL

SEQ ID NO: 7697 - protein, 1159 aa, unidentified
  REGION 1..1159: note = Description of Unknown:uncultivated organism sequence
MTTKKILGLDLGVGSIGWALIEMNNENPTSILGMGSRIVPLTTDDSTQFQKGQAITKNADRTQRRTARKGYDRYQLRRARLTQFLRANGMLPERTDEHIIELWQLRADAATEGKKLTLPQIGRVLYHLNQKRGYKHTKSDMSADSKQTKYVEEVNKRYKELQECNQTIGQYFYQKLVESAVQAPSGPYYTFRIKDQVFPRAAYMAEFDQIMNVQKQFYPDILTAELIDTLRNQIIFYQRPLKSCKHLVSLCEFEMKAYTNKETGKVVYSGPKCAPRTSPLAQLCAVWEAVNNITLFNKNNEYLSITLEQRQAMVEHLNTHEKMTAKDLQKILGISPKEGWSVGKAVGKGLKGNITLYQLRQALNGKYDRLLQMNLQMIDYVDEATGEVIARVADKVEQEPLYRLWHVVYSVQEREELGKALYKQFGIDDEEVVEALFKIDFVKPGYANKSHKFIRKLLPYLMKGYKYSEACEHIYVNHSNSMTKEQNAARELVDKIPLLLKNELRQPIIEKILNQMINIVNALKEKHGDIDEVRVELARKLKQSKDERAQATERINKNERENKNIEEKIREFGVRPSRVRIQKYKMWQESQERCFYCGKQIGAAEFLSGFDVEVEHIIPKSVLFDDSFSNKVCACRACNQAKGNMTARDFMETRGKVELDAYLQRIDQAYQEGRISETKRDHLLWSKEDIPQDFIDRQLRQSQYIAKKAVEILRSAIRDVYATSGSVTDFLRHIWGYDQILHNLNLPKYRDAELTEFVTYDHRGQEHQEERIKNWSKRIDHRHHAIDALTIALTRQGYIQRLNNLNTEHNSIEEEVRKVNPIMDKKYSLLEKYIYIQPHFTVQQVTEAVDGILVSFRAGKKVTTPAKRAIYRKGKRINVQTGLQVPRGALTEETIYGKLGNKYVVKYPLNHPSMKVDEIVDPTIREIVRARLNAFGGKAKDAFAQPLYSDAAQKMEIKSVRCYTGLQDKAMATVRFSEQGEAIGFAKTGNNHHIAIYMDSNGQYQESVVSFWQAVERKRYGLPIVIEDPKAVWDKVMNLDLPQEFLQTLPNDDWQFVVSLQSNEMFILGIEDGDFELAMENQDYQLLNKHLYRVQKIATKNYAFRHHIETSVDDKYDGVKKEMLSKQMQKLKITQSFDSFFALHPHKVRVNLLGEITNV

SEQ ID NO: 7698 - protein, 1225 aa, unidentified
  REGION 1..1225: note = Description of Unknown:uncultivated organism sequence
MKKILGLDLGVSSIGWSVISVAENGDPNEILGMGSRIIPLSTDDANEFSSGNAISKNQKRTQKRTARKGYDRYQLRRENLTIELRKNKMLPDERLIKLPVLDLWTLRANAATEGNQLTLPEIGRVLYHINQKRGYKHAKSDEAGEKKQTEYVTAVNQRFALILEKGQTIGQYFAEKLKESEVISEKGVFYTYRTKEQVFPRKAYEKEFDQIIAVQSKFYPDVFTEKFVHRLRNEIIFYQRNLKSCKHLVSLCEFEKREYKNKEGKIVYDGPKVAPRTSPLFQICRIWEFVNNIRLENGYRDVRKLSLEERFKVVRYLDNHEKMTTKDFLNLLGLKKNDAWDLKKYFGKNGVQGNITKAKLFNAIKDLPNAEKLLQFNLSTENSNLFDESTGEVLKVINDNFQNEPLYMLWHTVYSLSDKDELRKVLKKKYDINDESVVDSLFKIDFVKPGFGNKSAKAIRRILPFLQEGLVYSDACARAGYNHSNSLTKAENETRILLDRLPQIKKNELRQPVIEKILNQMVNVVNAIYDEYGKMDEIRVELARELKQSKDERNVTATNIAKRERENKDIEKKIGELGIRSSRSRIQKYRLWEESEKKCFYCGQTVQVKEFLSGFDVEVEHIIPKSLLFDDSFANKVCACRKCNADKGNKTAFDFMKGKSLDLFDAYVNRVNEFYKDGKISKTKKEHLLTTQSDIPTDFIERQLRQTQYISKKAMEMLKGVCHNVYATSGSVTNFIRHIWGYDEILHQLNFDRYKKGGLTEFRDFEHKGSSHKEERIQNWSKRLDHRHHAIDALVIAMTRQSIIQRLNHLNTERDVMFQEVEKQSKEWKNDYSLLQEWLRERKHFSSEEVADKVSKILISFKAGKRVATIGKRVKYEKGKKSVLQTGIVIPRGPLSEESVYGKIKVLETQKSIKFLFDNPHLIANSEIQTLVKARLSQCENDAKKAIQSLKNNPLVLASGKNLEKADCYSEKYVIKYNLEGFKAKDIESVVDGHIRDVLYKRLEEYGNKEKDAFKDLDRNPIYADAACKIPIKHVRCFTGLTAVVPVKSVENGNAIGFVKPGNNHHIAIYKDENGILQESVVTFWHAVERKKYGLPIVISNPKEAWKIAREKNCSKDFLECLPNENWIFEQSLQQNEMFVLGLSADDYEKALKEKDYALLNQHLYRVQKISSSNYMFRHHLETQIDDSVAAKEIGKFKNIQSFKALLQVNPQKVRISLLGKLICI

SEQ ID NO: 7699 - protein, 1132 aa, unidentified
  REGION 1..1132: note = Description of Unknown:uncultivated organism sequence
MKTRISLIVGKEAPLTKLSKSFPTHIDETLFCGLDLGIGSCGQALISSSKEKRTIRGSENLPGTISFLGVRAFDIAETKEKTGVKLKNPERRAKRLLRRVTARRADRMKKTRQFLMKSGILPADYHCMKDEWRERHEAATPWQWRLDALDRSLALWEWAVILMHYSKRRGFKSARKGDIAAKGSKGGTLDSTKANHEAMARFRTVAEMFDKDERFNTTLKAADGSEGVLKLKRNKDGNYTSMILRDDLLDEIRTVFESQRRFGNPLASAVIEREYLTILNQQKSMQDPIELLGYCPFIPAENRTTSFAPSFEISRALQRINNITLIHGDGSKSLLSNHILTVGGYAAFVAGFGKTKTIPWAALRKLWIIPNTVDFQDIREGLRKTAKDKGPLTKAAAEKEDFCNRSSKRGCAEGSYRLRNALGEEAWAQALEKGFQQIDQIAFSLAFYEVVEDDSSPFTILGSLAEKSIFSTLTAAVRADLTSDHPTLHEFKGACGVSSEVSRRLIPHLMTGITYDKAMAAAGFNHTESSFPFKDISNPVAKTVIREVMKQVVNLFDEAGALPGRIFIELGRDLGKSMDERNEMTRGIKDRTKEKDGNRDEVARLKNCSPSSVSDEDLLRYELYRDQSGYCPYSGDPLPNPERLYDADLQVDHILPRSRSHDNSFHNKVLVYTKSNQDKKSQTPYEWLSASPGKWQVFQTFILSMPSLKRQKKRNLLNETFANEEKTFAERNLNDTRYISRVILSYLEALYEEAGHKPVRDGGTRRVFTRPGAMTSLVRKAWGLENLKKDYNGQRIGDKHHAVDALVCACLAEGDAQWIAKISKAYGSLEKPYASHLALRDLETPWPNFRNDVVEALRQITVSRRERCGAGGPLHLETIYRGKQDENGKMIAFKRHPIVGKDEKNKAKASFTKDIDLEKIAGIHDERSRWLKDALLDWIKRGSPITPEALPRDPQGCLIRKVFVKTKNMQLRPWKQGSQPQGHVTSGTMVRCDVFSKKGQFHLVPIYKHQLIERTPPMRAIVAAKPDSDWTLIDSTFRFEFSLWKNSRFEFKHKKNGFIDGCYDSVNRSTGRIDYSRPDDGTCEKDDKGRDIKFGFSTLTGVVFFRKISVDRLGRKFLVKSEKRTWRGAVCI

SEQ ID NO: 7700 - protein, 568 aa, unidentified
  REGION 1..568: note = Description of Unknown:uncultivated organism sequence
MELGRDLGKSIKERNEISRGILERTKNRNANRENLEKHLGRPTSNEELLRYELYLEQSHLCPYCGEHLGKPVDILSNDFEVDHILPRSRSLDNSYDNKVLVHRKCNQNKGNATPFEFFGKGNKDGEEWRGFSSRLTSLHGIRNRKRRNLLNTSFADDETSLASRHLNDTRYIAKLVTAYLQAFYELAGEKSPTGKGGKKRVYVQPGPMTALIRKAWGLEDLKKDLQGNRIGDKHHAVDALVCALLSEGQRQFITRKEQGKNDAVREASVFGEIAKTYMLMEEKNEHQRIPKGIPAPWKNFRKDVATALDGMQVSRAETRKGRGSLHNETNYRIQPLKGGYETFSRKNLVDNLNKPLLKKLENLEKVKDIHLPCNQWLKKSLSKWIERGSPTETSQLPRDPQGAVIRKVTVSQGPKSGRVLPQGFVTSGSLVRIDIFSKPNKRRNKEYFIVPVYTYHISDESPPNKAITAHKNENDWVEIGSNFQFEFSLWPNSRVRIKKKDGPSLIGLYETVDRSGGTLSLCDPSDPKLKTRCSIKQGTTLFQKWTMDRLGREYHVPKEQRTWRGSNV

SEQ ID NO: 7701 - protein, 584 aa, unidentified
  REGION 1..584: note = Description of Unknown:uncultivated organism sequence
MTCLINETGKLPGRICVELGRDLGKSIKERNEISRGILERTKNRNANRENLEKHLGRPTSNEELLRYELYLEQSHLCPYCGEHLGKPVDILSNDFEVDHILPRSRSLDNSYDNKVLVHRKCNQNKGNATPFEFFGKGNKDGEEWRGFSSRLTSLHGIRNRKRRNLLNTSFADDETSLASRHLNDTRYIAKLVTAYLQAFYELAGEKSPTGKGGKKRVYVQPGPMTALIRKAWGLEDLKKDLQGNRIGDKHHAVDALVCALLSEGQRQFITRKEQGKNDAVREASAFGEIAKTYMLMEEKNEHQRIPKGIPAPWKNFRKDVATALDGMQVSRAETRKGRGSLHNETNYRIQPLKGGYETFSRKNLVDNLNKPLLKKLENLEKVKDIHLPCNQWLKKSLSKWIERGSPTETSQLPRDPQGAVIRKVTVSQGPKSGRVLPQGFVTSGSLVRIDIFSKPNKRRNKEYFIVPVHTYHISDESPPNKAITAHKNENDWVEIGSNFQFEFSLWPNSRVRIKKKDGPSLIGLYETVDRSGGTLSPCDPSDPKLKTRCSIKQGPTHIKKWTMDRLGREYHVPKEQRTWRGSNV

SEQ ID NO: 7702 - protein, 584 aa, unidentified
  REGION 1..584: note = Description of Unknown:uncultivated organism sequence
MTCLINETGKLPGRICVELGRDLGKSIKERNEISRGILERTKNRNANRENLEKHLGRPTSNEELLRYELYLEQSHLCPYCGEHLGKPVDILSNDFEVDHILPRSRSLDNSYDNKVLVHRKCNQNKGNATPFEFFGKGNKDGEEWRGFSSRLTSLHGIRNRKRRNLLNTSFADDETSLASRHLNDTRYIAKLVTAYLQAFYELAGEKSPTGKGGKKRVYVQPGPMTALIRKAWGLEDLKKDLQGNRIGDKHHAVDALVCALLSEGQRQFITRKEQGKNDAVREASVFGEIAKTYMLMEEKNEHQRIPKGIPAPWKNFRKDVATALDGMQVSRAETRKGRGSLHNETNYRIQPLKGGYETFSRKNLVDNLNKPLLKKLENLEKVKDIHLPCNQWLKKSLSKWIERGSPTETSQLPRDPQGAVIRKVTVSQGPKSGRVLPQGFVTSGSLVRIDIFSKPNKRRNKEYFIVPVYTYHISDESPPNKAITAHKNENDWVEIGSNFQFEFSLWPNSRVRIKKKDGPSLIGLYETVDRSGGTLSLCDPSDPKLKTRCSIKQGTTLFQKWTMDRLGREYHVPKEQRTWRGSNV

SEQ ID NO: 7703 - protein, 1126 aa, unidentified
  REGION 1..1126: note = Description of Unknown:uncultivated organism sequence
MLDPKPSLLLVGPDRPVTKLPKSFPSQVDESLTLGIDIGIGSCGLALIHQSEKDKPVIRGFSDMPGRISFMGVRTFDVPETKEKTGPKLKNPERRQARLLRRGTARRAQRMRFIRTLLKAEGLLPADYHVDSQEWKKHHEEATPWEWRVDGLERKLDPWHWAAVLIHFAKHRGFRSNRKSDLASKGEKDGTLESSKANHDALAHYRTLGDMFFNDTRFAERKRNRDGSYTSMILRGDLLAEIDELFEKQRTLGNPYASPTFQTEYIKTLQTQQPLQDPIALLEDCPFEHGEKRGTRHSPSFELSRALQKLNTLSLKSANGTEQTFPEFAKRHPAAYAAFISQFGTSKKVTWKQLRKIFSIPEEISFANLSMTAKPSRKKVAEKAEAVPKSISVLEGEDFVNRGARGCAESTAAFRSLLTDDWSEITRDSYEMLDEASFALTFYEVLEDEKSENTILGQVCAKCYSQPKLIQAIIRDLKESDKPTLHNFSGSVAVSMKASRKIISHLADGLVYSEAMKAAGYNHTDSNISLKSITNPIVKSVVRETMKQIIHLIDETGSIPGKINIELARDLGKSMDERNEISRGLDKRTTERNTHREEAAKILGSPAAEVSDEDLLKYELRHEQGGNCVYSGEVITDGELFTAAVQIDHILPRSRSHDNSYDNKVLVFAKHNQEKKNQTPYEWLGGPDSQAWQAHITLITEKRGMRGRKRRNLLDTTFGEREDEFLARNLNDTRYIGRLITAFLQDIYTIIGEKPPTEKDSKRRIFVRPGALTAMIRKAWGLEDLKKDIIGNRVGDKHHAVDALICACIGEGQSQFITGLEQRKSPFLKSLSMAWSDMEKSHDSRLTPLRLPTPWKDFRSSVVTALNLVNVSRREDRGGRGSVHDDTVYGRDKHGTAWKRTSLIATDGKKKSTFLTKLSQLEEIRGAREIDARNPWLRPALTAWIEAGSPLDHPPLDNRGKVINKLFRETAGNSLRQIDRGWVSNGNMIRCDVFSKGGKYALIPVYSHQLSCTEPPMKFISANKPESEWKSVDETYQFEFSLWKNSRFQVNEKVKKGAASVVVGCYAGLHRGTGKITYNLPNDHGADSFFVSPMTSLKFQKLQIDRLGRVFPIPKEKRTWRGKVCI

SEQ ID NO: 7704 - protein, 944 aa, unidentified
  REGION 1..944: note = Description of Unknown:uncultivated organism sequence
MFLNDPRFADRKRNRDGSYTAMILRGDLLAEIDELFEKQRVFGNPHASAAFQATYIETLQTQRPLQNPIALLEDCPFERGEKRGTRHSPSFELSRALQKLNTLTLRFANGTEQSFPDFIKRVPSAYAAFISQFGTSKKVTWKQLRKIFSIPEDISFANLSITQKAVNRKPAKKKDDQVTEKPEAAPKTISQLEGEDFVNRGARGCAESTALFRSLLSDDWNEITEESYEMLDEAAFALTFYEVLEDEKSEATILGQIHAKCHSQPKLVQAIIRDLKESEKPTLHNFSGSVAVSMKVSRNIISHLAAGLVYSDAMKAAGYNHTDSSISLKSITNPIVQSVVRETMKQIIHLIDETGRIPGKINVELGRDLGKSMDERNEISRGLDKRTDERNANRERAAEILNCEASEVKDEDLLKYELRHSQGGLCAYSGVVITDPELFSANLLQIDHILPRSRSHDNSFDNKVLVFTSANQDKGNQTPYEWLGGPDSEKWQKHIAHVNSMRGIRGRKRRNLLDTTFGEREDEFLARNLNDTRYIGRLVTAFLQDIYTMIGEKPPTEKDSKRRIFVRPGALTAMIRKAWGLEDLKKNIDGNRIGDKHHAVDALICACIGEGQSQYITGLEQRKSPFLKSLSKAWSDMENSHDARLTPLRLPPPWKDFRASVVTALNLVNVSRREDRGGRGSVHDDTVYGRDKDGTSWKRTSLIATDGKKKSTFLTKLSQLEEIRGAREIDIIKNPLNSWFRNALRDWILAGSPLDQPPKVPVISSKETGKPENIRDKFITKVFRETHGNSLRKIDRGWVSTGNMIRCDVFSKGGKYALIPVYSHQLSSTEPPMKFIGANKPESDWKAIDETYQFEFSLWKNSRFQVNEKPKNGAAVGQIVTGCYASLHRVLGQITYNMPDDHGADSLVIAPMTSLKFQKLQIDRLGRVFSIPKEKRTWRGKVCI

SEQ ID NO: 7705 - protein, 1126 aa, unidentified
  REGION 1..1126: note = Description of Unknown:uncultivated organism sequence
MLDPKPSLLLVGPDRPVTKLPKSFPSQVDESLTLGIDIGIGSCGLALIHQSEKDKPVIRGFSDMPGRISFMGVRTFDVPETKEKTGPKLKNPERRQARLLRRGTARRAQRMRFIRTLLKAEGLLPADYHVDSQEWKKHHEEATPWEWRVDGLERKLDPWHWAAVLIHFAKHRGFRSNRKSDLASKGEKDGTLESSKANHDALAHYRTLGDMFFNDTRFAERKRNRDGSYTSMILRGDLLAEIDELFEKQRTLGNPYASPTFQTEYIKTLQTQQPLQDPIALLEDCPFEHGEKRGTRHSPSFELSRALQKLNTLSLKSANGTEQTFPEFAKRHPAAYAAFISQFGTSKKVTWKQLRKIFSIPEEISFANLSMTAKPSRKKVAEKAEAVPKSISVLEGEDFVNRGARGCAESTAAFRSLLTDDWSEITRDSYEMLDEASFALTFYEVLEDEKSENTILGQVCAKCYSQPKLIQAIIRDLKESDKPTLHNFSGSVAVSMKASRKIISHLADGLVYSEAMKAAGYNHTDSNISLKSITNPIVKSVVRETMKQIIHLIDETGSIPGKINIELARDLGKSMDERNEISRGLDKRTTERNTHREEAAKILGSPAAEVSDEDLLKYELRHEQGGNCVYSGEVITDGELFTAAVQIDHILPRSRSHDNSYDNKVLVFAKHNQEKKNQTPYEWLGGPDSQAWQAHITLITERRGIRGRKRRNLLDTTFGEREDEFLARNLNDTRYIGRLITAFLQDIYTIIGEKPPTEKDSKRRIFVRPGALTAMIRKAWGLEDLKKDIIGNRVGDKHHAVDALICACIGEGQSQFITGLEQRKSPFLKSLSMAWSDMEKSHDSRLTPLRLPTPWKDFRSSVVTALNLVNVSRREDRGGRGSVHDDTVYGRDKHGTAWKRTSLIATDGKKKSTFLTKLSQLEEIRGAREIDARNPWLRPALTAWIEAGSPLDHPPLDNRGKVINKLFRETAGNSLRQIDRGWVSNGNMIRCDVFSKGGKYALIPVYSHQLSCTEPPMKFISANKPESEWKSVDETYQFEFSLWKNSRFQVNEKVKKGAASVVVGCYAGLHRGTGKITYNLPNDHGADSFFVSPMTSLKFQKLQIDRLGRVFPIPKEKRTWRGKVCI

SEQ ID NO: 7706 - protein, 1121 aa, unidentified
  REGION 1..1121: note = Description of Unknown:uncultivated organism sequence
MNQDTLSPLVGKDHPIPKLSKTFPTTICEELILGIDIGVGSCGLALIHRNAAEKPVIQGFPEFPAKISFLGVRTFDLPEFKEKTGVKLKNPERRAARLQRRGVARRAQRMKAIRRLLVSEKLLPADYTVQSTDWKKKHEAAVPWKWRVDGLDMQLTAEEWAMVLIHFAKHRGFRSNRKSDLASKGEKGGTLESTQQNHEALQDFRTVGEMFARDSRFTERKRNREGSYTSVVLRADLLAEIATLFETQRTLGNPHATVAFEETYVRVLQTQKPLQDPLKLLEDCPFLAGHKRGCKNAPSFELSRALQKLNSLTLRTLAGHETPFPVFAETRPEGYARFLVDFGKSPKVTWRQLREFFTIPENLAFKDLTIAQKKKGRPKPGEIEKPLKSIADLEKDDFVNRGSTGCAQSTAIFRKLMGDNWQTITQNDFSPLDDAAFALTFYEVIEDDESEQTILGQVRHRCAAYPELIAAVTHDLLENQKPQLAGFKGSVSVSTEVSRRIIPHLASGMVYSAAMEAAGFTHTDSNVSLKTISNPVVKSVIRETMKQIVHLIDVVGVIPGTINIELGRDLGKSMDERNDIDSGIRKRTTERNTHRDEVAEILGIEPHAVSDERLLRYELYKEQGGECAYSGEQLPSGKQLFDAHLQIDHILPRSRSHDNSYDNKVLVYTHANQDKGNRTPCEYFSSISPERWLDYQAMVRSMRGLRPRKRRNLLDSTFAERESEFLARNLNDTRYIGKVVTTFLQTIYTIAGESSPTEKDSRRRINIRPGALTSLVRKAWGLEDLKKDLSGKRIGDKHHAVDALICACIDEGQGQFVTALSKAWKDMENLHEHSLVPKRLPTPWPDFRNTVILALNMIHVSRREDRSGRGSLHNDTIYGRDKTGTVWKRTTLLTIEKGKAAPRFRKSGDVETIRGARAEDVAKNPKNQWFRDALLNWIAAGSPIERPPVNPAGMPIVKVFVSERSNSLRKIPRGWVSNGDMIRCDVFSKNGKYALVPVYSHQLSQDAPPTRYIKANKPESEWLELDATFQFEFSLWRNSRFRVTEKAKRGNAVGNLIEGNYTSLHRGTGLVSYNLPDDHGADPLGVSPVTSIKFEKLYVDRLGRVYPVPKEKRTWRGKVCI

SEQ ID NO: 7707 - protein, 1078 aa, unidentified
  REGION 1..1078: note = Description of Unknown:uncultivated organism sequence
MQLREDIILGLDIGIGSVGWAAVQANNDGSFSPVYLPSSNGDSQYALGVRAFDIPENPKTKELLNVARREKRRQRVTIRRRRKRMQKVRNLLVKHGLLRSDDPQQTHYPYRRERPQHDPWQLRQEGLQRMLRNEELAVILIHIAKHRGFKSNSKKDKSLGGGTETGKMLSAVSSLEARIAESGAETVGEYMAGLDRKRNRRGFDDKAVYDNTILRDLLAKEANILFERQRSFGQNNASDALLTSFKEIAFRQEPLKSVEGLIGSCLFEPGEKRAPKHAYTSEKFRLVQRLTVIRLRYPEGRSERIASLKVKELAGTLGTSKGITYKALRNFLKLDSSVLFEGLDYGKKDKAGKEVDAEKSDIVTRTRACAEGSHTFYKVLGKNIYSGFVEKYTENGQRVIDAASRIISVNDDLQKISEELANLPLPEQEVRLLTEAVHEGRFSHFRGTMNLSLKAMQNILPHMIEEQDYAAGCEASGYDHAKTRPVNPDAIRNPVVRRILKEVRKQFRAVIRELGVIPGRVHIELLRDMGKSAEERNEIENSIKRRTAEKKQAREYFASLVHKRPEDISVTELMRYELWKEQGGKCAYWILWRHCGGGRHYTAGHMPEGSIALTSLLDEYNQVQIDHILPRSRTFDNSFHNLCLCSTAANQAKGNLTPWEWLGRDNPEAWHEYEAWIRSLRIKGLKKRNYTLKNLDQDREGRFHERNLTDSRYAARLVLAWFAEEYGNLGVDDHDLEGCAINRFRSRPGQLTSILRQSWGVNGLKYDDMKQRVGDRHHALDALVVACCTESTLQKMTQLYKLMEHHQEKYRLTPQIPAPWDNFRNDAARMLRNVFVSRAERGNTKGALHEETLRQVRVEIDDNGNEREIIYERVAIKDLNENDLVRIKDAERNKWLIDILRAWIAAGKPKGTPPSSPKGDPIRKVRLRRGAFTSGIKVARGEGLAQADNAKMVRTDVFTKDGKYYLIPVYTSQIARGEAPNRAVVANKPESEWTLIDDTFSYLFSMTPNSYIVTEDRKGLIREGYFTSTDRTTAAITLRQANDHTKEIRSGTKTLKLFQKYRVDRLGRLYRVRKEVRP

SEQ ID NO: 7708 - protein, 1003 aa, unidentified
  REGION 1..1003: note = Description of Unknown:uncultivated organism sequence
MPRVLGLDIGIGSCGWAVVDLPEIDAATGEVQGEFAIVACGARSFDVPEEPDTRELKNKARRQARGQRRVVRRRRQRIRAIRRLLAEHGLPADPGPLPKGACGDLVWHLRAQGLDRRLEPGEWARVLIHIANHRGFKSNSKRDRDNKSDSGKVLAALAATDAKLAGWRTFGEMLARDQDLAQRRRNRSGSYERTPLRERVEEEVAKLFAAQRRFGNDFASGEFEAAYRGLAFFQRPLRTSEELIGACRFLPKEKRAPKHAPSFERFRFLARLNNLKVCPPGVRPRFLTAEERREAMALFGTQKSVTFKTLRKAIGLRAGTTFDGLPLRRDDPETATFAEFKGTMALQESLGEARFAHLLAHAPEQLDAAATALIQLEGVEEIRGRLREAGLAERDVAALTTAESLARFGQFRGTGHVSTAACRRLIPHLEAGLVYSEACQREGWDHAAIGLSRVQDVRNPVVSKILRECTRQIAVVLREFEPVDAVHLEMARDVGKSPEERQEIRKGMDERAAQRERNRQEFETLLGRRPNDEELLRYELWLEQNHRCPYTFPDEAAYIPPECLLATDNRVQVDHIFPYSRSGDDSFRNKVLCHVRANQEKGRRTPFEWFGEDAERWRLFEARIQGLKQMHPQKRRKLLARAFAERENQYRARHLNDTRYAMRVLRHELESSFPTLGSRRLFPRPGAITFLLRRAWGLDELKKGGALGDRDHALDAIVVACTTEALLNRLTRLHQELEELGTGRATPLVESPLGGTPQARERFRQMVKAAAEAVFVSRPETRRGRGPVHDATLYGFERGADGEETQYERWNVWELKPADLDRLKGEPARNAALKAILAAWLERAGREQTKPEKFWQTDPPRFPNGPPIRRVVLRRPSAKAGIKLRRGEGEAHADQASMVRVDVFRKAGKFYLVPIYAWQVATMDRPPDRAIVSAAPEDRWPVVDGSYEFLWSLHPDSSFAPRTVRAKSSRAISARSTGATAGSVFHHTGPGTARRSSGSPRRR

SEQ ID NO: 7709 - protein, 1034 aa, unidentified
  REGION 1..1034: note = Description of Unknown:uncultivated organism sequence
MARVLGLDIGIGSCGWAVVELPEIDPATGEVQGEFAIAACGARCFDVPEEPKTRELKNKARRQARGQRRVVRRRRQRNRAIRRLLAEHGLPADPGPLPKGACGDLVWKLRAEGLDRRLEPGEWARVLIHIANHRGFRSNSKRDRDNKSETGKMLPAILATDAKLAGWRTFGEMLALDRELAQRRRNRSGSYERTPLRARLQEEVAKLFAAQRQLGNPAASPDLESAYRELAFFQRPLQTSEELIGPCRFLPKEKRAPKHAPSFERFRFLARLANLEVCPPAGRPHRLGDEERRKARALFATQKTVTFKTLRRAIGLPAGTTFDGLPLRRDDPESATFAEFKGTMALRESLDEARFAHLLAHAPEQLDAAATALIQHDEVEEIRARLHAAGLEAGDVAALTTDESLARFSQFRGTGHVSTAACRRLIPHLEAGLVYSEACQREGWDHAAIGLSRVRDVRNPVVSKILRECTRQIAVVLREFGPVDAVHLEMARDVGKSPEERQEIRKGMDERAAQRERHRDAFETLLGHRPNDEALLRYELWSEQNHRCPYTFPDEDAFIEPGCLLATDNRVQVDHIFPYSRSGDDSFRNKVLCLVRANQEKRRRTPFEWFGADAERWRLFEARIQGLKQMHPQKRRKLLARAFAERENQYRARHLNDTRYAMRVLRHELEILFPTLGSRRLFPRPGAITFLLRRAWGLDELKKGGALGDRDHALDAIVVACTTEALLNRLTRLHQELEELGTGRATAPVETPLGGTPQARECFRQMVKAAAEAVFVSRPETRRGRGPAHDATLYGFERGADGEETQYERWNVWELKPADLDRLKGDPARTVALKAILAAWLERADREHTKPEKLWQSDPPRFSNGPPIRRVVLARPSTKSGIKLLRGDGEAHADQASMVRVDVFTKGGRFYLVPVYAWQLAALASAPSRAIRNLADEKDWYQIDGTFAFLWSIHPGSYLKAVAADGSKFEGYFRSLDRSNGRVSFSPASNGDSKAQRRFKTMTLKSFEKYHVDRLGRLHRIDKEPRLWHGAVCS

SEQ ID NO: 7710 - protein, 1032 aa, unidentified
  REGION 1..1032: note = Description of Unknown:uncultivated organism sequence
MPRVLGLDIGIGSCGWAVVDLPEIDAATGEVQGEFAIVACGARCFDVPEEPKTRELKNKARRQARGQRRVVRRRRQRIRAIRRLLAGHDLPADPGPLPKGACGDLVWKLRAEGLDRRLEPGEWARVLIHIANHRGFRSNSKRDRDNKSDSGKVLAALAATDAKLAGWRTFGEMLARDQDLAQRRRNRSGSYERTPLREWVEEEVAKLFAAQRDRGNPAASPDLESAYRELAFFQRPLRTNEKLIGACGFLPKEKRAPKHAPSFERFRFLARLNNLKVCPPGVRPRFLTAEERRKARALFATQKTVTFKTLRKAIGLPAGTTFDGLPLRRDDPEAATFAEFKGTMALQESLGEARFAHLLAHAPEQLDAAATALIQLEGVEEISGRLREAGLAEPDVAALTTTESLARFGQFRGTGHVSTAACRRLIPHLEAGLVYSEACQREGWDHAAIGLSRVKDVRNPVVSKILRECTRQITVVLREFGPVDAVHLEMARDVGKSPEERQEIRKGMDERAAQRERHRQEFENLLGRRPNDEELLRYELWLEQNHRCPYTFPDEAAYIPPECLLATDNRVQVDHIFPYSRSGDDSFRNKVLCHVRANQEKRRRTPFEWFGEDAERWRLFEARIQGLKQMHPQKRRKLLARAFAERENQYRARHLNDTRYAMRVLRHELETLFPTLGSRRLFPRPGAITFLLRRAWGLDELKKGGALGDRDHALDAIVVACTTEALLNRLTRLHQELEELGTGRATPLVETPLGGTPQARERFRQMVKAAAEAVFVSRPETRRGRGPAHDATLYGFERGADGEETQYERWNVWELKPADLDRLKGDPARTAPLKAILAAWLERAEREHTKPEKLWRTDPPRFPNGPPIRRVVLRRPSTKSGIKLLRGDGEAHADQASMVRVDVFTKAGRFYLVPVYAWQVAQLDGPPMRAIVAHKDEVDWTPMDQSFAFVFTIYPGSYIRATNRSGELFEGYYSATDRSSATLALQPATGVGKPARPGTKLLASFEKYHVDRLGRLHRVEKEPRMWHGVVCS

SEQ ID NO: 7711 - protein, 1034 aa, unidentified
  REGION 1..1034: note = Description of Unknown:uncultivated organism sequence
MPRVLGLDIGIGSCGWAVVDLPEIDAATGEVQGEFAIVACGARSFDVPEEPDTRELKNKARRQARGQRRVVRRRRQRIRAIRRLLAEHGLPADPGPLPKGACGDLVWHLRAQGLDRRLEPGEWARVLIHIAKHRGFKSNSKRDRDNKSDSGKVLAALAATDAKLAGWRTFGEMLARDQDLAQRRRNRSGSYERTPLRERVEEEVAKLFAAQRRFGNHFASGEFEAAYRGLAFFQRPLRTSEELIGACRFLPKEKRAPKHAPSFERFRFLARLNNLKVCPPGVRPRFLTAEERRKAMALFGTQKSVTFKTLRKAIGLRAGTTFDGLPLRRDDPETATFAEFKGTMALRESLGEARFTHLLAHAPEQLDAAATALIQLEGVEEIRGRLREAGLAEPDVAALTTAESLARFGQFRGTGHVSTAACRRLIPHLEAGLVYSEACQREGWDHAAIGLSRVQDVRNPVVSKILRECTRQIAVVLREFGPVDAVHLEMARDVGKSPEERQEIRKGMDERAAQRERNRQEFETLLGRRPNDEELLRYELWLEQNHRCPYTFPDEAAYIPPVCLLATDNRVQVDHIFPYSRSGDDSFRNKVLCHVRANQEKGRRTPFEWFGEDAERWRLFEARIQGLKQMHPQKRRKLLARAFAERENQYRARHLNDTRYAMRVLRHELESSFPTLGSRRLFPRPGAITFLLRRAWGLDELKKGGALGDRDHALDAIVVACTTEALLNRLTRLHQELEELGTGRATPLIETPLGGTPQARERFRQMVKAAAEAVFVSRPETRRGRGPAHDATLYGFERGPDDREFQYERRNVWELKPADLDRLKGEPARNAALKAILAAWLERAGREQTKPEKLWQTDPPRFPNGPPIRRVVLRRPSAKAGIKLRRGEGEAHADQASMVRVDVFRKAGKFYLVPIYAWQVATMDRPPDRAIVSAAPEDRWPVVDGSYEFLWSLHPGSFVRAENREGQIFEGYFRSLDRSNGRISFSPHWTGDSKAQLRFTTKTLKSFEKYHVDRLGRRYRVEREPRMWHGVVCS

SEQ ID NO: 7712 - protein, 1128 aa, unidentified
  REGION 1..1128: note = Description of Unknown:uncultivated organism sequence
MKPQKSGIIGADGPLTKLPQTFPTKIDDSLFCGLDLGIGSCGQALISTSKHKRIIRGFESLPNFISFLGVRAFDVPEVNDKTGVKLKNPERREKRLLRRTIARRADRMKQVRRFLIANNVLPPDYHCMKEEWRHRHEQSTPWQWRLDALSRILTNWEWAAILMHYAKRRGFKSARKGDIASKGSKGGTLDSTRANHEALAAYQTVAGMFENDSRFIETVKGHDGSEREVKFKRNKDGNYQSMVLRADLVNEVRAVFAAQREFGNVHASAASEAEYIAILNEQKPMQNPIALLGDCPFLPGEKRTTSFAPSFELSRALQRLNTITLILLDGSKQLLSEHILANGGYGSFVADFGNNSKISWADLRKRWNIPAATQFKDVREGGRGTAKSGGGGSSEKDDFCNRSSKRGCAKGTCLIRNAVGGEAWSEILSKDLAPLDDIAFSLAFYEVVEDADSDFTILGSLASKYLGAELLAAVQKDLTGERPTLHEFKGACGVSSKVCRRLIPHLMEGMTYDKAMKEAGFCHTDTLAAFREISNPVVKSVIREVMKQVVNLFDEAGALPARIHIELGRDLGKSIMERNEMDRGIRDRTKAKDSHRDAVAGFKNCSPGSVSDEDLLRYELYLEQGGYCPYSGEQLPNPEHLYGEDLEIDHILPRSRSHDNGYDNKVLVFTKANRDKKNRTPYEWLSASPLAWKEFQTRILAIHGIRRRKIRNLLNESFATDEQTFSERNLNDTRYISRVIMSYLEALYEEAGHTPVRDGGKRHVFTRPGAMTSLVRRAWGLENLKKDLDGKRIGDKHHAVDALVCACLAEGDAQWISRLSKCYGSMELMNNPRLVPLGLETPWSGFRADVVEALRQITVSRRERCGAGGPLHLETIYRARQDENGKTIAYKRDSVIGSDLKGKPVARYTKPEDLDKIAGIHHERSRWLKDSLLEWIKRGSPVDLAKPDLLPRDPQGCLIRKVFVQQKSMQLRPQPQGHVTSGTLIRCDVFSKKGQFHLVPIYKHQLIERTPPMRAIVAAKLDDNDWTLIDSTFHFEFSLWTNSRFELIYTDGEKIEGCYRGVSRNTAVIAYFPPDRFGEQKDENGKNPYPPVSCKTGVSTFRKINVDRLGRSFFVKGEKRTWRGAVCI

SEQ ID NO: 7713 - protein, 1121 aa, unidentified
  REGION 1..1121: note = Description of Unknown:uncultivated organism sequence
MRHQLEYPPLVGVGHPLPKLPKTFPETICDDLTLGIDIGVGSCGLALVHRTGIGKPTFKGLPDFPGRISFLGVRTFDLPEVREQTGIKLKNPERRNKRMLRRAVARRAQRMRAVRSLLVSEGILPQDYSIRSAAWQQYHEKAKPLDWRVQGLDRELDPLEWAAALIHFAKHRGFRSSRKADIAAKGKEGGTLDATKRNHEALEKFRAVGEMLAKDERFAERKRNREGSYSSIVLRADLLNEISLLFERQRELGNSHATADFKERYIRSIQKQRPLQDPIKGLGKCPFTGEHRGARNAPSFELSRALQKLNSLTLRTSDGKEIPFPAFAIQCLGGYARFCESFGCAQRVTWKHLREVFQIPADLSFVGLSDSRPRKKKGTAGDLNGIPKTPAQLEAEDFVNRGSTGCAHATAIFRKILGAEWENVTRDGWEPLDEAAFALSFYEVVEDEDSDQTILSQIHNRCTAQPVLVEAITRDLLGDGKPALANFSGSVSVSSTVSRQIIPHLCAGMIYSEAMKSAGYNHTDSDISLSSITNPVVQSVIRETMKQIVHLIDETGKIPGTINIELARDLGKSIDERNEIDSGIRKRTTERNTNREEAARILDISSHEVTDEGLLRYELYKEQGGLCPYSGNTLPANKELFGADLQIEHILPRSRSHDNSYDNKVLVYTASNQNKGNRTPFEYFSSLAPERWEQFQTTIESMRGIRHRKRRNLLNTSFAEKEAEFLERNLNDTRYIGRVVTAFLQTLYTIAGEKRPADKGSLRRIYVRPGSLTSLVRRAWGLENLKKDLHGKRIGDKHHAVDALVCACVGEGQSQFVTALSKAWCAMEQMHEHSLVPKRLPLPWPDFRNTVVQSLDSINVSRREDRSGRGALHNDTVYGRDASDTIWKRTSLIATEGNKQTARFNRSEQVETIRGARITDIEKNPKNLWFRNALLEWIALGSPISSPPKNPSGKPILKVFVEERSSSLRRIPRGWVNNGDMIRCDVFSKKGKYALIPIYSHNLAQNTPPMRFIKANKPESEWTEVDETYSFEFSLWRNSRFRVTSKPKGSLGTGEVKEGNYVSLHRGTGKITYNLPDDHGADSQHVSPVTSLKFEKLYVDRLGRVFPIPREKRTWRGKVCT

SEQ ID NO: 7714 - protein, 1128 aa, unidentified
  REGION 1..1128: note = Description of Unknown:uncultivated organism sequence
MNEQESSPSLTGPGGPLPKLPKTFPSHIDEQLFCGLDIGVGSCGQALVSPAGVKVRGFEDLPDPIAFLGVRTFDVPETKEQSGVKLKNPERRQKRLMRRVIARRAHRMRQVRRLLMARGVLPADYHCQADEWRVRHEQATPWQWRLEALERALTKWEWAVILMHYAKRRGFKSARKSDKEAKGADGGTLQSVRANHEALKAYRTLAEMFGRDQRFNTTVQGTGGTARKVEMRRNRAGNYVAMVLRADLLEEIRAVFLSQRERGNPHAGQDFEAAYLEILTSQKPMQDPVKLLGDCPFLPGCKRTTSYAPSFELSRALQRLNAVTLVHPDGARELLSEHILANGGYGPFVAAFGKARSIPWAAIRTMWGIPADVQFKDVLEGSRKSSRTGAVESIAAAEKRDFCNRSSARGAAEGSYLLRKAVGDNTWNKLLAGDLATADDVAFSLAFHEVVEDEDSEFTILGSMAAKKIPAEFVEPVRNDLLGERPTLHRFKGACGVSAELCRRILPHLMRGLTYDKAMMAAGFNHTQTVVPFDQITNPIVKSVIREVLKQVVHLFDEAGALPGRIHIEVARDLGKSIDERNEMERGISKRTRAKDKNRDEVAKLRGCERAAVTEEDLLRYELYLEQGGICPYSGESLPNVERIYGPDLQVDHILPRSRSHDNSFDNKVLVYASANQHKQNKTPHEWLAGEPEAWQGFRTRIQAMPGLRFRKRRNLLDETFGTEDQEQKFAERNLNDTRYICRLVMGYLEALYGLQGHAPTRDGGARRVFARPGPMTALVRRAWGLENLKKDNDGKRIGDKHHAVDALVCACLAEGEAQWITRLGQAYSAMERAHVGALAVRGLPPPWADFRRDVVAALRKITVSRRERCGGGGALHYETIYRARQGEDGGTLAFKREALVGLENGKPKPAFTRDSDLEQIAGINEERSRWLKEALLAWISEGSPLDAGRLPRDPQGCLIRKVFVKQKNIQLRRQRQGHVTSGTIVRVDVFSRKGKYHLVPVYAHQLAGRTPPMHAIVAHKPESEWTLVDESFRFEFSLWKNSRFEIRFKTGRVIEGDYSGVNRSDGGITYNPPDDASTRKSGDGRPVNYKFATKTGVVSFRKISVDRLGRAFPVKGEKRTWRGAVCI

SEQ ID NO: 7715 - protein, 1078 aa, unidentified
  REGION 1..1078: note = Description of Unknown:uncultivated organism sequence
MQLREDIILGLDIGIGSVGWAAVQANNDGSFSPVYLPSSNGDSQYALGVRAFDIPENPKTKELLNVARREKRRQRVTIRRRRKRMQKVRNLLVKHGLLRSDDPQQTHYPYRRERPQHDPWQLRQEGLQRMLRNEELAVILIHIAKHRGFKSNSKKDKSLGGGTETGKMLSAVSSLEARIAESGAETVGEYMAGLDRKRNRRGFDDKAVYDNTILRDLLAKEANILFERQRSFGQNNASDALLTSFKEIAFRQEPLKSVEGLIGSCLFEPGEKRAPKHAYTSEKFRLVQRLTVIRLRYPEGRSERIASLKVKELAGTLGTSKGITYKALRNFLKLDSSVLFEGLDYGKKDKAGKEVDAEKSDIVTRTRACAEGSHTFYKVLGKNIYSGFVEKYTENGQRVIDAASRIISVNDDLQKISEELANLPLPEQEVRLLTEAVHEGRFSHFRGTMNLSLKAMQNILPHMIEEQDYAAGCEASGYDHAKTRPVNPDAIRNPVVRRILKEVRKQFRAVIRELGVIPGRVHIELLRDMGKSAEERNEIENSIKRRTAEKKQAREDFASLVHKRPEDISVTELMRYELWKEQGGKCAYWILWRHCGGGRHYTAGHMPEGSIALTSLLDEYNQVQIDHILPRSRTFDNSFHNLCLCSTAANQAKGNLTPWEWLGRDNPEAWHEYEAWIRSLRIKGLKKRNYTLKNLDQDREGRFHERNLTDSRYAARLVLAWFAEEYENLGVDDHDLEGCAINRFRSRPGQLTSILRQSWGVNGLKYDDMKQRVGDRHHALDALVVACCTESTLQKMTQLYKLMEHHQEKYRLTPQIPAPWDNFRNDAARMLRNVFVSRAERGNTKGALHEETLRQVRVEIDDNGNEREIVYERVAIKDLNENDLVRIKDAERNKWLIDILRAWIAAGKPKGTPPSSPKGDPIRKVRLRRGAFTSGIKVARGEGLAQADNAKMVRTDVFTKDGKYYLIPVYTSQIARGEAPNRAVVANKPESEWTLIDDTFSYLFSMTPNSYIVTEDRKGLIREGYFTSTDRTTAAITLRQANDHTKEIRSGTKTLKLFQKYRVDRLGRLYRVRKEVRP

SEQ ID NO: 7716 - protein, 1128 aa, unidentified
  REGION 1..1128: note = Description of Unknown:uncultivated organism sequence
MDYKIGLDLGISSVGWAVIQTDCDGNPVKIENLGSRIFDKAENPKDGSSLALKRREARGVRRRLRRRRHRRDRVLSLLEEYNIISKKEVQAMFSNSEYRFEKNVYELRVEGLDTLLTAKELARVLINFVKRRGYKSNSISEEKSDKDIGKLLTATVENDKIMKENDYKTVAQMYLNDERFTTNKNFNDGRKILKIRNTTDSYTSTVRRSDLVNEIKLILQKQKELNSKITDKFIEKYLNIFESQRSFEEGPGGDSPYGGNQIEKMIGRCTLEPREPRAVKASYTFEYFKLLQDINHIKLECKENIDGKVKNISKSLSNEQRKELINLAKKSDTISFDKIRKVLNLDYNVTFNMVNYNLKKVSNIEDLFSLSEKETKLREFQSYHKIRKILDKIEKGIVDKLSIDTLNKLAYALSVFKNDKSIKKYLKENCRELTDELIENLLEISFSKVGNLSIKAMEKLIPFLEQGLTYDKAVEKVYGKDVNINVKRKNELSFNTIKDDITNPVVKRAVSQTIKVVNAIVNKYGEPLCINIELARELSKTFEERNRISKKNEERKSENEKAKLEIQEMGKFNVTGQDIIKYRLWKEQDEICIYSGHKITPDELFTELVDIDHIIPYSISFDDTFNNKVLVLSSENRKKGNRVPIEYLRKNGMHVDEYKLRIETTYIKKNNYKKLKKLLVEGITREDIDNFKERNIKDTQYLSRLMYNLLRNNLKFKRNDGIKIKVQAVNGAITSHIRKRLGIEKIRANGDKHHAIDAVIIAIITPKLIQSITNFYKYNELKNCNIKENKIINEETGEYVDLSKFPQPYQGFREELEIRSLQNENLMHEALKNSKLVRYTDIENVKPIFVSRMPRRKVTGAAHKDTIRGLRKHDNNFYSVTKTPLTKLSLTKDEMDIDGYSEKQKIDDIYLYKALLKRLKEFDGNAKEAFKDSFYKPNKDGSKGAIVKKVKIEKKVSSFVTLNDGKSLAENGSMVRIDVFYIENEGYYLVPVYTKNVIEKNLPNKASIAKKPESEWKEMNDKDFIFSLYPNDLVHIKSKKPIEFIPSENQKLENKLYNDVFAYYVSSDISSASIEIKTHDNEYKRRGLGIKTLLEIKKYEVDVLGEYHEVRIPEKRNDFKNVKGGKKA

SEQ ID NO: 7717 - protein, 1105 aa, unidentified
  REGION 1..1105: note = Description of Unknown:uncultivated organism sequence
MAVDHYALGLDIGIDSVGWAILCNNAEGEPIKVENLGVRIFDKAEQPKTGESLAAPRRNARSARRRLRRHRHRLERIRFAIERAGILSCDEIQALYTQGGFAISPYQLRAEALDRPLSREETVRVLIHLAQRRGYKSNSTAEAAKDEKEIGKVKQAIEENRLCMQQHGYRTVGEMMYRDDRFWQTNPDGSRYHQTRNKADDYRFTIERSAVVDEVHQLFEAQRRLHTPWMTEEFEAEYLSILESQRNFDEGPGPGSPFRGGITEKVGICTFEKEPPEPRAAKATYTFEYFKLLQDLNHIRLADSRNFSVPLTQEQREILKKAAMQSASLTYKQIREKLNLGEDVYFNGLSYTKQAKEETEKKKWPQMQSYHKIRAALNKISKGAILSLTQDQLDAIGTILTLYKNDKNRLKALDEAGIPAELHQALLPLSFSKFGNLSVKAMRKLIPYLEDGWRYDEACKAVYGDHRGLQTESRKSKLSLRDMEDEITNPVVRRAIAQSIKVINAVVRTYGAPDVVRIELAREMGHNYQERKKMEKRRDENQAANERAKEQISEYKGDHATGLDIVKFKLFKEQDGVCLYSGKNLDISRLFEPGYVDVDHIIPYSRCFDDSYQNKVLVLSSENRQKGNRLPYEYFGQDEERWHAFEVRVENLIRSYRKRQKLLKRELTEEESADFIQRNLNDTQYITRAVYNLVKDNLVFADSPYRKRPVQAVNGAVTAMLRGRWGVRKVREDGDLHHCLDAAVVAATSPGMIQKLTNYNKRRETAERIPGGYVDASTGEVLTKKEYDRKFSPEFPSPWPLFRQELEARLDPVDPRAAIDRLKLPTYESDEEIRPIFVSRMPNHKVTGPAHAETIRSGKMGDGFTVTKTSLANLKLNKQGEIEGYYHPESDRLLYEALLQRLKEFGGDGSKAFAEPFHKQKRDGTPGPRVDKVKIFEKSTLNLQVHDGVAANGSMVRIDVFHVEDDGYYFVPIYIADTKKDRLPNKAVIAYKPYQEWKEMAAEDFIFSLYPGDLVRIQSRKGIKLNISKGGTGEKVIVRRDGLYYYRTAGITVGSIQIETHDRRYFQPGVGIKTLQSIEKYQVDVLGNYHKVSLPEKRMPFNKEG

SEQ ID NO: 7718 - protein, 1100 aa, unidentified
  REGION 1..1100: note = Description of Unknown:uncultivated organism sequence
MQTFHYTLGLDIGIASVGWAVLQNDSDGEPIKIQNLGVRIFEKAEHPKTGESLAAPRREARSARRRLHRHRHRLQRIRWLLEKQGIMPEQDILELYQRGAFSISPYELRCEALERPLSKEEAVRVLIHLAQRRGYQSNSTAEAAKEEQETGKIKAAITENRRIMDEKGYRTVGEMLWKDERCWQKNPDGTKFHQPRNKADSYRFTVRRSDVVEEVHSIFRRQRELGVTWMTEELEEAYLSILESQRSFDEGPGGDSVYKVDFNKRIGICPFEKSEHRAAKATYTFEYFKLLQDINHIRLVESGQPSRPLCPDQRESLRRLAFRSASVSFQQMRKELNLADTVTFNCLYYGEDGVAKAEKRKWPQMQSYHKIRLALDKVAKDAILTLSTAQLDEIGRILTLYKNDERRLQALHSAGIPEVYHASLLPLSFSKFGKLSLTAMKKLIPFLEQGKRYDEACAEAGIVRRDTSSVQKGAKLSIDDLEEITNPVVRRAVSQTIKVINAVVRTYGTPDAVHIELAREMSRSFADRQKLQKRQDENRKQNERLKEQIMEVKRSTAGGLDIVKFKLFQEQDGICMYSGKNLDISRLYEPGYVDVDHIIPYSRCFDDSYQNKVLVLASENRQKGNRLPYEYFGQDAQRWHSFEVRVETKIRNYRKRQKLLKRQFTEEESQTFTARNLQDTQYITTVIFHLIKDHLEFTQVRPASRQVQAVNGAITAMLRGRWGIQKIREDGDLHHCLDAAVVACTSPGMIQRLTAYNKYRESPINGQYLDHSTGELLTKKEYDEKYAPKFPEPWPRFRQELEARMEPADPRGAIDRLKLSTYDSDEPIKPIFVSRMPNHKVTGAAHAETIRSSALGDGYTVSKVPLTRLNLDKNGEIPDYYNPASDRLLYDALVERLKAFGGKGEQAFAEPFYKPKADGTPGPLVKKVKVYDKSTLNLSVRNGVADNGDMVRVDVFYVPGDGYYLVPIYVADTQKAVLPNCAVVAHKKYALWKEMDDSDFLFSLYPGDLIRIQSKKGITLNISKGGTGEAKILRKDALFYYCGTDIGSGNISIETHDRQYSQPGLGFKTLLLVEKYQVDVLGNYYKVTSPEKRMPFSKEG

SEQ ID NO: 7719 - protein, 1100 aa, unidentified
  REGION 1..1100: note = Description of Unknown:uncultivated organism sequence
MQTFHYTLGLDIGIASVGWAVLQNDSDGEPIKIQNLGVRIFEKAEHPKTGESLAAPRREARSARRRLHRHRHRLQRIRWLLEKQGIMPEQDILELYQRGAFSISPYELRCEALERPLSKEEAVRVLIHLAQRRGYQSNSTAEAAKEEQETGKIKAAITENRRIMDEKGYRTVGEMLWKDERCWQKNPDGTKFHQPRNKADSYRFTVRRSDIVEEVHSIFRRQRELGVTWMTEELEEAYLSILESQRSFDEGPGGDSVYKVDFNKRIGICPFEKSEHRAAKATYTFEYFKLLQDINHIRLVESGQPSRPLCPDQREALRRLAFRSASVSFQQMRKELNLADTVTFNCLYYGEDGVAKAEKRKWPQMQSYHKIRLALDKVAKDAILTLSTAQLDEIGRILTLYKNDERRLQALHSAGIPEVYHASLLPLSFSKFGKLSLTAMKKLIPFLEQGKRYDEACAEAGIVRRDTSSVQKGAKLSIDDLEEITNPVVRRAVSQTIKVINAVVRTYGTPDAVHIELAREMSRSFADRQKLQKRQDENRKQNERLKEQIMEVKRSTAGGLDIVKFKLFQEQDGICMYSGKNLDISRLYEPGYVDVDHIIPYSRCFDDSYQNKVLVLASENRQKGNRLPYEYFGQDAQRWHSFEVRVETKIRNYRKRQKLLKRQFTEEESQAFTARNLQDTQYITTVIFHLIKDHLEFTQVRPASRQVQAVNGAITAMLRGRWGIQKIREDGDLHHCLDAAVVACTSPGMIQRLTAYNKYRESPINGQYLDHSTGELLTKKEYDEKYAPKFPEPWPRFRQELEARMEPADPRGAIDRLKLSTYDSDEPIKPIFVSRMPNHKVTGAAHAETIRSSALGDGYTVSKVPLTRLNLDKNGEIPDYYNPASDRLLYDALVERLKAFGGKGEQAFAEPFYKPKADGTPGPLVKKVKVYDKSTLNLSVRNGVADNGDMVRIDVFCIPEDGYYWVPIYVADTQKAVLPSRAAVAYKPYGDWKEMEDSNFLFSLYPGDLIRIQSIKGVKLKIAKNGTGEPEITRKDGMFYYCGANICTGAVRIEAHDRQYSQPGLGFKTLQSVEKYQVDVLGNYYKVTLPEKRMPFTKEG

SEQ ID NO: 7720 - protein, 1132 aa, unidentified
  REGION 1..1132: note = Description of Unknown:uncultivated organism sequence
MGYRIGLDIGITSVGWSVIENEENGNPKRIIDLGSRIFDAAENPKDGSPLAKYRRDARGTRRRLRRKKHRIERTKRLLERYNLISKKEIEDMYNDCNFQFNIYELRVQGLEEKLTNKELARVLISFVKKRGYKSNSKSEESSKEAGKLLTATKENEELMKLKNYRTVAEMYLNDERFKLKNKNGEYILDKNGNPLIKIRNSTDDYKNTTLRKLLVKEINMILSKQKELNSFVTDQFIEEYLEIFEGQRNFDDGPGEQSPYSGNLIENMLGKCTFEPEERRAPKATFTFEYFKMLQTLNHIKIEKIIINEDGSKEKIKYPLTLEQKKLIRDLLLSKATVTYDNLRSLLGLSNFERFNLVSYQSSIDFSEGANKLAEKDRKINEFESYKKIRTAINRVDKELIKMLSQDELDSIGYALTIYKNDDKRIQFLKENTNLNDEVIDELLKLSFSKVGNLSIKAMKKIIPELEKGLTYDKAVDEVYEDFRGIVNTEKRRKLRLKDLEQEISNPVVRRGLSQAIKVLNAIILKYNDKYGKPDVVVVELARELGKNFKDRNEIQKSQEQNMRINELAVSQIKELGKENPTGKDIVKYKLWKEQDGICLYSGNHISIDSLFTEAVDVDHIIPYSNCFDDSYNNKVLVLASENRQKGNRIPYRYIKDIGRNLGEYEVRVNNVIKNYNKKQRLLKQEFTKDDAKEWKSRNLNDTKYICKLMYNLIKNHLEFSDNPNFDRKVWTVNGAITAHIRKRLGIEKTRDGDTHHAIDATVIAITTQGMINKLTKYYQYNDGKYMTSKGEYVDLETGEILDAKKYEEENGIYFPEPWKNFRDELDIRVNCNSKERMIECLESKKIYTYDDYEDLEPIFVSRMPRRKVKGTAHLDTIRGIKNENGEIKTITKTDLTSLKLKNGEIEGYPENCKNDDKLLYQALKEQLIKYNGNTKEAFKEDFYKPKSDGTRGPLVKKVKIEAKTTLGVELNDGKAFAANGDCIRIDVFYVDGEGYYFIPIYASDVVKDKLPNKACVAGKNYSDWKEMDDKDFIFSLYPKDLVHIKKESKIKLNPREKNKEKIENEEVLGYYVKSDISSASIEIETNDNKYFARGVGIKRLLILEKYEVDILGNYHKAKLPEKRLPFNINKK

SEQ ID NO: 7721 - protein, 1132 aa, unidentified
  REGION 1..1132: note = Description of Unknown:uncultivated organism sequence
MGYKIGLDLGVGSVGWAVLKTDEQGNPIKIEDLGSRVFDKAENPKDGSSLALKRREARGVRRRLRRRRHRRDRVLSLLENYNIISKKQVEEMYNNRDYKFEKDVYELRVEGLDTLLTSKELARVLINFVKRRGYKSNSKSEESENKDTGKLLTATIENDRIMKEHNYRSVAEMYLKDSSFVKVLSNGKEIRKIRNTTNEYKSTVKRADLVNEIKLILKKQNELNPKVTSEFINKYLEIFESQRAFEEGPGGNSIYGGNQIEKMLGRCTFEKNEYRAMKATYTFEYFKLLQDINHIRIEYVESVDGKRKNVSNALNEVQRKAIIDMAKRKDTIKYSDIRKAINIPEDARFNTVRYDYSLSKDYNEAIKLSEEKSNIKEFQSYHKIRKALDKVEKNLIEKYSSEELNKIGYALSVYKSDDKRISYLKANIPNITDEIIEKLLPLSFSKTGNLSIKAMNKIIPYLEQGLTYDKAVDNVYPDFRGNINTKRKTKLSLNNLEEEIPNPVVKRAVSQTIKVLNAIVDRYGNPESVNIELARDLSKTFEERRKIEKDNQDRMITNEKVKREIEELGKTNVTGQDIVKYRLWKEQGEVCVYSGKHISPEDLFSELVDVDHIVPYSISFDDSYNNKVLVLSSENRMKGDRVPLQYLRESNKDDSDYIVRVNTIYQGRNNSKKLKRLLIESISREDLEGFKERNLKDTQYLSKVVHNLIKNNLIFSENENVKIKVNVVKGAITSHIRKRLGIEKIRSNGDEHHAIDATIIACVTPKLIQDITKFYKKQEVFYYQKGKDFVDRYTGEIVEFNKLAQENEKYFPEPYNGFRKELEIRTLRNEELMHEELKRIKYDTYENILKIKPIFVSRMPRRKVTGAAHKDTIRGLRKYDNVYYSVKKTPLQDLKLTKDGNDIEGYPEKQKIDDLYLYKGLVERLKMFNGDAKEAFKEDFYKPNKDGSKGQIVRKVKIESKISSFVPLNSGKSMADNGSMIRIDIFYVEGEGYYFVPIYTADVLKDKLPNKGCIAYKPQSEWKELDDKYFIFSLYPNDLIYLEKEDNIELTSKDKEKIQAKSIFSYYVKAGISTASITIINHDNSYMLPSLGIKGLLSMKKYQVGVLGDIHEVKLPEKRLKFNLKNKKGGKA

SEQ ID NO: 7722 - protein, 1178 aa, unidentified
  REGION 1..1178: note = Description of Unknown:uncultivated organism sequence
MSLRYTLGLDIGIASVGWAVLKNDINGVPIKIEDLGAVAFSAAEPTGKVQKKKSNSKTPAPTLASNLRKIRCPRRTIRRKRHRKDRIKQLIQQNGIMTRVEMAEMFEHSQFETSVYELRVQALERALTKQEFVRVLIHLAQRRGYKSNSKSEEAKDKENGKVKIAISENKQCMEENGYRTIGEMLLNDDRFWKHNPDGTKIFVPHNHPDDYRTTVERSMVEDEIRLIFSRQRALGVPYATSEFEEAYLKIWGGQRNFDDGPGYEIPPKDDGTEGKYSRYGGNMIEKMLGHCTFEKNEPRAAKGSYSAEYFRLLQDVNHLRLVKNNGESSALTAEQKQIYIDFVMESADASYEKLREKLGLSNDVLFNMLRYGSDEIGKVERKKLGHMQFYHKMRKALNTVQEELREKLKLSNDILFNMLRYGSDEIGKVECKKLGHMKFYHELNTVQKDAISTVSWEQRDEIARILLCYKSDDKRKAQLEKLDIPREFIPALLTLSTSKTAHLSVKALRKLIPYLKKGMTYAEACKEVYGEQKSSVTKKNKLSLFDIEPINNPVVRRAVAKTIRVINAVVRKYGPPEVVRVELAREMGKSKADRDKIDAEQKANAKRNEELRQQIKKIKGAEPTGQDIVKFKLFQDQNGVCLYSGQNLDITRLFEAGYVEIDHIIPYSISLDNSYANKVLVLKEENQNKGRRTPYEYFGADSKRWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKPVFVSRKPKRKTTGAAHKDTIYRKTDGGYIDKVPLTKLTLDKKTGEIKNYYAPESDRLLYEALKKRLEEFDGNAKEAFAKPFYKPKRDGTSGPLVKKVKLYKTYNNTVEVKRGDARASNKHIGCARNDSNSMIRVDVFYIEGDGYYYVPIYITDVVKDELPNKAVVRRKLPKDWKKMDDKDFLFSIYPNDLIYVERKEVFELTAPKNSSLDPTISKTKGLFYYRSFDSNTGSFKIYTHDRSYSKKSLGGKTLSCLKKYTVDVLGNYSEVSLPEKRKPLRG

SEQ ID NO: 7723 - protein, 1100 aa, unidentified
  REGION 1..1100: note = Description of Unknown:uncultivated organism sequence
MKQIPYVLGLDIGITSVGWAVIQNDIHGEPIKIERLGVRIFDGAEQPKTGASLALPRRQARGARRIVRRRRHRKERIKKLICDSGILSSEEMELLFECGKFDEDVYSLRVSALDRLLTKEELVRLLIHFAQRRGYKSNSRSEEAKEEKETGKVKQAISANKQRMLEHGYRTVGEMLWKDELFHRVNPDGSVILAVHNTQEEYKTTVERSMLEEELRLIFSKQREFGSVWTTEAFEEQYIAIWGSQRNFDEGPGGNSKYGGAQIEKMLGECTFEEGELRAPKASYTAEYFRLMQTVNNMKIVGHGMPAEFLSEEQRKIFVQAAMASPSLTYTQLRKKLGIAEDYFFNGLFYGDKTAVQVEKKELKLMPFYHELRKALNKVEKNAIAQLSQEQMDEIARIITLYKSDDNRVTKLKESGIPEKFYPALLELSASKASHLSLKAMRKLLPYLEQGETYDKACKAVYGSHDGRCGDTQRKQRLSVMDAGEINNPVVLRAVSQSVKVINAIVREYGAPEIVRVELAREMGKNLDMRNQMKKRQTKNAERNEALRKQIEEIKHDTPTGQDIVKLKLFQEQNGVCLYSGKNLDVSRLFEAGYVDVDHIIPYSISFDDSYNNKVLVLASENRQKGNRIPYEYMGQDAQKWHQFETLVGTQIRSYKKRKNLLARSIPNQDDFKRRNLVDTQYISRVVYNLINDHLEFSETGNYKKKTQTVNGAITAQIRKRLGIDKIRENGDLHHAADAAVIACVSPGMVQKITNYSKRCECAFTRAGYVDYETGEVMTKEAYDEKYAPKFPAPWTMFRKELEARLSDNPRAEIDLLKLATYENDEEIKPVFVSRMPNHKVTGAAHLETIRSGKKQGGTVTKTALSKLKLDKKTGEIVGYYNRESDELLYQALKAQLEKFGGDGEKAFTQPFYKPKHDGTPGPLVKKVKIFEKATLTVPTNQKKGVAANGSMIRVDVFHVEKDGYYFVPVYVSDTVAKELPNRAVVANKPYEQWKPMKESDFLFSLCAGDLIRICNNKPIKLKQAEGGTGNPELLKKEGLYYYNGLNISSGALHIQLHDRSYSQSSLGGKRLGLIEKYEVDILGNYRPVKLPEQRQRFKR

SEQ ID NO: 7724 - protein, 1100 aa, unidentified
  REGION 1..1100: note = Description of Unknown:uncultivated organism sequence
MKQIPYVLGLDIGITSVGWAVIQNDIHGEPIKIERLGVRIFDGAEQPKTGASLALPRRQARGARRIVRRRRHRKERIKKLICDSGILSSEEMELLFECGKFDEDVYSLRVSALDRLLTKEELVRLLIHFAQRRGYKSNSRSEEAKEEKETGKVKQAISANKQRMLEHGYRTVGEMLWKDELFHRVNPDGSVILAVHNTQEEYKTTVERSMLEEELRLIFSKQREFGSVWTTEAFEKQYIAIWGSQRNFDEGPGGNSKYGGAQIEKMLGECTFEEGELRAPKASYTAEYFRLMQTVNNMKIVGHGMPAEFLSEEQRKIFVQAAMASPSLTYTQLRKKLGIAEDYFFNGLFYGDKTAVQVEKKELKLMPFYHELRKALNKVEKNAIAQLSQEQMDEIARIITLYKSDDNRVTKLKESGIPEKFYPALLELSASKASHLSLKAMRKLLPYLEQGETYDKACKAVYGSHDGRCGDTQRKQRLSVMDAGEINNPVVLRAVSQSVKVINAIVREYGAPEIVRVELAREMGKNLDMRNQMKKRQTKNAERNEALRKQIEEIKHDTPTGQDIVKLKLFQEQNGVCLYSGKNLDVSRLFEAGYVDVDHIIPYSISFDDSYNNKVLVLASENRQKGNRIPYEYMGQDVQKWHQFETLVGTQIRSYKKRKNLLARSIPNQDDFKRRNLVDTQYISRVVYNLINDHLEFSETGNYKKKTQTVNGAITAQIRKRLGIDKIRENGDLHHAADAAVIACVSPGMVQKITNYSKRCECAFTRAGYVDYETGEVMTKEAYDEKYAPKFPAPWTMFRKELEARLSDNPRAEIDLLKLATYENDEEIKPVFVSRMPNHKVTGAAHLETIRSGKKQGGTVTKTALSKLKLDKKTGEIVGYYNRESDELLYQALKAQLEKFGGDGEKAFTQPFYKPKHDGTPGPLVKKVKIFEKATLTVPTNQKKGVAANGSMIRVDVFHVEKDGYYFVPVYVSDTVAKELPNRAVVANKPYEQWKPMKESDFLFSLCAGDLIRICNNKPIKLKQAEGGTGNPELLKKEGLYYYNGLNISSGALHIQLHDRSYSQSSLGGKRLGLIEKYEVDILGNYRPVKLPEQRQRFKR

SEQ ID NO: 7725 - protein, 1100 aa, unidentified
  REGION 1..1100: note = Description of Unknown:uncultivated organism sequence
MKQIRYTLGLDIGVASVGLAVLQNDLHGEPMKIERLGVRIFEKAENPKDGSSLAAPRRQARGSRRVVRRRKHRKERIKRLITSTGMITREQMDELLSSGQYEKCVYELRVDALERLLTVEEYVRLLIHFAQRRGYQSNSKSEEAKDAKENGKVKQAISENRQRMQDHGYRTVGEMFWKDDLFKRINPDGSIVLVVHNQPDDYKVTVERQMLKEEIRLIFAKQREFGNTWASEKFESAYLEIWGSQRNFDEGPGGDSPYGGSQIEKMLGTCTFEDPEPRAPKASYTAEYFRLLQTVNHLKTVGHGLPAEFLDDDQRKIVIEFAMSSPNGTYGQLRKKLALPDDIFFNNLSYGEKSAEQVEKTKLGQMQFYHKVRIALDHVKKGAIRELTVDQLDEISRILTLYKSDANRTTHLQEAQIPEEYIPELLALSASKAAHLSIKAMKKMIPYLEEGYTYDKACIAAYGHHDGENPEAKRDQKLTIGMAGEIYSPVVLRAVSQMIKVINAIVREYGPPEVVRVELAREIGKSRKVRDKLKTQQEANFEKNEAIRKQVEEYKGSAPTGQDIVKLKLFQEQNGVCLYSGENLIISKLFEKGYAEVDHIIPYSISFDDSYSNKVLVLAGENRNKGNRIPYAYFGHDEFRWNRFETLVNSQIRSVKKRKNLLCRALSEEQIKGFKNRNLTDTQYMSRVIYNLINDHLKFAETENYKPKMRTQAVNGAITAQVRKRLGIDKLRANGDLHHAKDAAVIACISPGMIQKITRYSQRCECAWTKAGYVDYETGEVMTKDAYDEKYAPRFPEPWLHFREELEARLSNDPRGEIDLLKLATYDSDEELRPVFVSKMPNHKVSGAAHQETIRSGKQEGGTVSKVALTSLKLDKTGEIPGYYRPEDDPLLYEALKERLRAFGGEGKKAFAEPFYKPKHNGEPGPMVKKVKIFEKATNPVPVNSGLAKTGKRVRVDVFHVENEGYYFVPVDVADTVKDELPNRAAVKGKPMEQWKEMDESDFLFSLYSGDLIHIMSGTKITMKLKDGAEGAESIEIDDALLYFSNFDIANAQIDVSTHDRRYTKHGMGVKTLSLIEKYRVDVLGNYTPVKLPEKRMRFK

SEQ ID NO: 7726 - protein, 1100 aa, unidentified
  REGION 1..1100: note = Description of Unknown:uncultivated organism sequence
MKQIPYVLGLDIGITSVGWAVIQNDIHGEPIKIERLGVRIFDGAEQPKTGASLALPRRQARGARRIVRRRRHRKERIKKLICDSGILSSEEIELLFECGKFDEDVYSLRVSALDRLLTKEELVRLLIHFAQRRGYKSNSRSEEAKEEKETGKVKQAISANKQRMLEHGYRTVGEMLWKDELFHRVNPDGSVILAVHNTQEEYKTTVERSMLEEELRLIFSKQREFGSVWTTEAFEEQYIAIWGSQRNFDEGPGGNSKYGGAQIEKMLGKCTFEEEELRAPKASYTAEYFRLMQTVNNMKIVGHGMPAEFLSEEQRKIFVQAAMASPSLTYTQLRKKLGIAEDYFFNGLFYGDKTAVQVEKKELKLMPFYHELRKALNKVEKNAIAQLSQEQMDEIARIITLYKSDDNRVTKLKERGIPEKFYPALLELSASKASHLSLKAMRKLLPYLEQGETYDKACKAVYGNHDGRCGDTQRKQRLSVMDAGEINNPVVLRAVSQSVKVINAIVREYGAPEIVRVELAREMGKNLDMRNQMKNRQTKNAERNEALRKQIEEIKHDTPTGQDIVKLKLFQEQNGVCLYSGKNLDVSRLFEAGYVDVDHIIPYSISFDDSYNNKVLVLASENRQKGNRIPYEYMGQDVQKWHQFETLVGTQIRSYKKRKNLLARSIPNQDDFKRRNLVDTQYISRVVYNLINDHLEFAETGNYKKKTQTVNGAITAQIRKRLGIDKIRENGDLHHAADAAVIACVSPGMVQKITNYSKRCECAFTRAGYVDYETGEVMTKEAYDEKYAPKFPAPWTMFRKELEARLSDNPRAEIDLLKLATYENDEEIKPVFVSRMPNHKVTGAAHLETIRSGKKQGGTVTKTALSKLKLDKKTGEIVGYYNRESDELLYQALKAQLEKFGGDGEKAFTQPFYKPKHDGTPGPLVKKVKIFEKATLTVPTNQKKGVAANGSMIRVDVFHVEKDGYYFVPVYVSDTVAKELPNRAVVANKPYEQWKPMKESDFLFSLCAGDLIRICNNKPIKLKQAEGGTGNPELLKKEGLYYYNGLNISSGALHIQLHDRSYSQSSLGGKRLGLIEKYEVDILGNYRPVKLPEQRQRFKR

SEQ ID NO: 7727 - protein, 1102 aa, unidentified
  REGION 1..1102: note = Description of Unknown:uncultivated organism sequence
MKKIPYTLGLDIGITSVGWSVLENDLYGEPLKIENLGVRIFSGAEHPKDGSSLAAPRRQARSSRRVIRRRRHRKERIKHLILSFGLVSPEEMDRLLSSSQEKSVYELRVDALARALTPQEAVRLLIHFAQRRGYRSNSKSEEIKEGAETGKVKQAIQENRQRMAEKGYRTVGEMLWKDPLFKRVNPDGSLVLTVHNSPDDYKITVERTMLAEEIRLIFHTQRALGSTWAAVELEERYLDIWGSQRNFDEGPGGNSPYGGSLIESHLGRCTFEPDQPRAPKSCFTAERFRLLEFANKLKIVGHGFPAEFLQEDQRRILLEFAMTSPNGTYAQLRKKLGLSEDTFFNNLYYGENEAAKVEKKKLGLMPFYHTLRKALSRIEKNAVDTLSPTQLDEIPRILTLYKADQSRIEKLQELGLPERYFPVLLELSPSKAMHLSLSAMKKLLPYMEQGFLYDKACAQVYASHTGSIGSATRSTKLSLEMIEEISNPVVRRAVSQAIKVINAIVRQYGPPEVVRIELARELSKPKKIRDQLEKKQQNNAAWNDEIRQQIQEYKKEPPTGQDIVKFKLFHQQNGLCLYSGKNLDLSRLFEPGYVDVDHIIPYSISFDDSYNNKVLVLTSENRQKGNRLPFEYFGHDQDRWQRFETLVGTQIHSFQKRNNLLCHTLNEEQRSNFKKRNLVDTQYLSTVLFHLIEDHLLFAETGNYKRKTQAVNGAITAHIRKRLGIEKVRANGHLHHAKDAAIVACVSPGMIQKITNFSKRRECAWTKEGYVDYETGELLTKEAYEEKYAPKFPPPWPKFSQELEARLSEDPRREIDFLHLSTYDSDEVLSPVFVSQAPNRKITGAAHEETIRSAKEPGGTVSKVPLSSLKLDNNGEIADYYRPEDDPLLYEALKARLLAFGGSGKHAFTEPFYKPKHNGQPGPLVKKVKLYKKATLTVPVGHGIAANGKMVRLDVFYVQGEGYYFVPLYTADTVKPDLPCLAVTTSKKDPSWKRMQEEDFLFSLYSGDLVRIVSSKGIKLNLAKGAEGPASLTVQDALLYYGGFNISTCALNLTTHDGRYWQSGLGGKRLSLIEKYQVDVLGRYSRVSLPEKRMRFSLHGIS

SEQ ID NO: 7728 - protein, 1101 aa, unidentified
  REGION 1..1101: note = Description of Unknown:uncultivated organism sequence
MSESHYALGLDIGIGSVGWAVLQNNLNGEPIRIWDLGVRIFDKAEQPKTGESLAAPRRDARSTRRRLRRHRHRLERIKYLLEQTNIMTCQEIKEFYERGGFTVTPYQLRAEALDRLLTKEEIVRVLIHLAQRRGYKSNSTAEAASNKEDGLVKAAIKENQDCMMKNGYRTVGEMMYRDQRFWQTNPDGTRYQQTRNKADDYRFTVDRISVVDEIHQIFAAQRRLGSAWMSETLEQVYLSIFESQRSFDEGPGGNSPFRGGVSEKVGSCTFETAEPRAAKATYTFEYFKLLQDLNHMRLTGKGLPSRPLDQSQRELLIAAAMQSPSLNYGQIRKKLALDENTYFNDLSYGDRSQEEAEKKKWPQMQSYHKLRTALNKVSKNAIQTLSIQQLNEIGSILTLYKSDANRIDALRKANIPEMFDQELLPLSFSKFGNLSIKAMERLIPLLECGQRYDEACSSIYGDHRGRQSEGRKNRLSLSDIEEITNPVVRRAVSQTIKVVNAVVRTYGPPDVIRVELAREMSRSFDERRKMEKRQEENRAANERAKEQIAEYKGDHATGLDIVKFRLFKEQDGVCLYSGKNLDISRLFEPGYADVDHIIPYSRCFDDSYQNKVLVLASENRQKGNRIPYEYFGQDEDRWHSYEVRTENLIRSYRKRQKLLRKGLTDEESQGFIERNLKDTQYITRAVYHLLRDHMLFAESRYEKSPVQPVNGAVTSMLRGRWGIQKIREDGDLHHCLDAAVVASTSPGMIQQLTVYNRQRESLEKTPGVYVDVSTGELVERENCDTRRCPQFPQPWPHFRQELEARLDPVDPRHAIDLLKLNTYESNEEIRPVFVSRMPNHKVTGSAHAETIRSKKMGDGYTVTKTALADLKLNKFGEIEGYYNPQSDTLLYDALLTRLKEFGGDGKKAFAEPFYKPKRDGTPGPRVNKVKIFEKSTLNLLVREGVAANGNTVRIDVFQVSDDGYYFIPVYVADTKKAMLPSKAVVAHKPYDQWKEMSGQHFIFSLYPGDLIRIRSRKGIKLKLAKGGTGESEISRQDGLYYYRGGDISTGAISISTHDRRYESRGIGIKTLQSIEKYQVDVLGNYHKVNLPEKRIPFTKEG

SEQ ID NO: 7729 - protein, 1101 aa, unidentified
  REGION 1..1101: note = Description of Unknown:uncultivated organism sequence
MSESHYALGLDIGIGSVGWAVLQNNLNGEPIRIWDLGVRIFDKAEQPKTGESLAAPRRDARSTRRRLRRHRHRLERIKYLLEQTNIMTCQEIKEFYERGGFTVTPYQLRAEALDRLLTKEEIVRVLIHLAQRRGYKSNSTAEAASNKEDGLVKAAIKENQDCMMKNGYRTVGEMMYRDQRFWQTNPDGTRYQQTRNKADDYRFTVDRISVVDEIHQIFAAQRRLGSAWMSETLEQVYLSIFESQRSFDEGPGGNSPFRGGVSEKVGSCTFETAEPRAAKATYTFEYFKLLQDLNHMRLTGKGLPSRPLDQSQRELLIAAAMQSPSLNYGQIRKKLALDENTYFNDLSYGDRSQEEAEKKKWPQMQSYHKLRTALNKVSKNAIQTLSIQQLNEIGSILTLYKSDANRIDALRKANIPEMFDQELLPLSFSKFGNLSIKAMERLIPLLECGQRYDEACSSIYGDHRGRQSEGRKNRLSLSDIEEITNPVVRRAVSQTIKVVNAVVRTYGPPDVIRVELAREMSRSFDERRKMEKRQEENRAANERAKEQIAEYKGDHATGLDIVKFRLFKEQDGVCLYSGKNLDISRLFEPGYADVDHIIPYSRCFDDSYQNKVLVLASENRQKGNRIPYEYFGQDEDRWHSYEVRTENLIRSYRKRQKLLRKGLTDEESQGFIERNLKDTQYITRAVYHLLRDHMLFAESRYEKSPVQPVNGAVTSMLRGRWGIQKIREDGDLHHCLDAAVVASTSPGMIQQLTVYNRQRESLEKTPGVYVDVSTGELVERENCDTRRCPQFPQPWPHFRQELEARLDPVDPRHAIDLLKLNTYESNEEIRPVFVSRMPNHKVTGSAHAETIRSKKMGDGYTVTKTELADLKLNKFGEIEGYYNPQSDTLLYDALLTRLKEFGGDGKKAFAEPFYKPKRDGTPGPRVNKVKIFEKSTLNLLVREGVAANGNTVRIDVFQVPDDGYYFIPVYVADTKKAMLPSKAVVAHKPYDQWKEMSGQHFIFSLYPGDLIRIRSRKGIKLKLAKGGTGESEISRQDGLYYYRGGDISTGAISISTHDRRYESRGIGIKTLQSIEKYQVDVLGNYHKVNLPEKRIPFTKEG

SEQ ID NO: 7730 - protein, 1135 aa, unidentified
  REGION 1..1135: note = Description of Unknown:uncultivated organism sequence
MGYKIGLDLGVGSVGWAVMRTDEKGNPIRIEDLGSRVFDKAEHPKNGASLAAPRREARGTRRRLRRRRHRRDRVLSLLENYNIISKKEVKEMFDSKDYRKEKNVYELRVEGLDTILTSKELARVLINFVKRRGYKSNSKSDEASNKETGKLLTATVENDKIMKENNYRTVAEMYLKDSRYVMNLSNGYKILKIRNTTDEYKSTVRREDLLNEIKLILNKQHELNSKITSEFIEKYIDIFESQRSFEEGPGGNSIYGGNQIEKMLGKCTFEKGEYRAMKATYSFEYFKLLQDINHIKIEYQKDEAGTIKNVSESLNESQRKEIIELAKKRDTIKYKDIRKVIDIPEYATFNTVRYDYSVSKDLKEVIEQAEDKSNIKEFQSYHKIRKALDKVKKGKINEISKVDLDNIGYALSVYKSDNNKTEYLKNKVKSLNEEEIKALLPLSFSKTSNLSIKAINKIIPYLEEGKTYDKAVNEVYKDFRGNINTKRITRLSLNNLDEEIPNPVVKRAVSQTIKVLNAILKKYGEPDAVNIELARELAKNFEQRRKIDLENQEKRAENDRIKEQIEELNIKTNITGQDIVKYKLWQEQNGVCIYSGHKITLNEVFDESTDVDHIIPYSISFDDSYANKVLVLASENRVKGNRVPLEYFKQENKDDSIFRVRIENTYRQKNKIKKMKKLLTESISREDILGFKERSIKDTQYLSKVVHNLIRNNLKFAENNNFKRKVEVVNGTITSHIRKRLGIEKIRSNGDEHHAIDAVIIACVSPQLIQDISNFYKVKEMKNLKSKGKDKFVDRETGEIIDFNILSQMYEKYFPEPYKGFRKELEIRTLRNEELMHEALKKINYDTYENILNIKPIFVSRMPRRRVTGAAHKDTIKGLRRHDDCYYSVKKTALKDLKYNKEKNEIEGYPEKQKRDDIYLYEGLLNRLKAFDYDPKLAFKEDFYKPNKDGSIGQLVKKVKIESKTTSFVPLNGGKSMADNGGMIRIDVFFVENDGYYFIPIYTADVLKEKLPNKACVPGKEWKIIEDKDFIFSLYPNDLIYIENNKGINLKPLNKDNDELVVNKLFAYYVKAGISTASITIINQDKSYEQPSLGLKSLMLIKKYQVGVLGDIHEVKIPEKRVEFNLKNKKGGKKA

SEQ ID NO: 7731 - protein, 1101 aa, unidentified
  REGION 1..1101: note = Description of Unknown:uncultivated organism sequence
MSESHYTLGLDIGIGSVGWAVLQNNLNGEPIRIWDLGVRIFDKAEQPKTGESLAAPRRDARSTRRRLRRHRHRLERIKYLLEQTNIMTCQEIKEFYERGGFTVTPYQLRAEALDRLLTKEEIVRVLIHLAQRRGYKSNSTAEAASNKEDGLVKAAIKENQDCMMKNGYRTVGEMMYRDQRFWQTNPDGTRYQQTRNKADDYRFTVDRISVVDEIHQIFAAQRRLGSAWMSETLEQVYLSIFESQRSFDEGPGGNSPFRGGVAEKVGSCTFETAEPRAAKATYTFEYFKLLQDLNHMRLTGKGLPSRPLDQSQRELLIAAAMQSPSLNYGQIRKKLALDENTYFNDLSYGDRSQEEAEKKKWPQMQSYHKLRTALNKVSKNAIQTLSIQQLNEIGSILTLYKSDANRIDALRKANIPEMFDQELLPLSFSKFGNLSIKAMERLIPLLECGQRYDEACSSIYGDHRGRQSEGRKNRLSLSDIEEITNPVVRRAVSQTIKVVNAVVRTYGPPDVIRVELAREMSRSFDERRKMEKRQEENRAANERAKEQIAEYKGDHATGLDIVKFRLFKEQDGVCLYSGKNLDISRLFEPGYADVDHIIPYSRCFDDSYQNKVLVLASENRQKGNRIPYEYFGQDEDRWHSYEVRTENLIRSYRKRQKLLRKGLTDEESQGFIERNLKDTQYITRAVYHLLRDHMLFAESRYEKSPVQPVNGAVTSMLRGRWGIQKIREDGDLHHCLDAAVVASTSPGMIQQLTVYNRQRESLEKTPGVYVDVSTGELVERENCDTRRCPQFPQPWPHFRQELEARLDPVDPRHAIDLLKLNTYESNEEIRPVFVSRMPNHKVTGSAHAETIRSKKMGDGYTVTKTALADLKLNKFGEIEGYYNPQSDTLLYDALLTRLKEFGGDGKKAFAEPFYKPKRDGTPGPRVNKVKIFEKSTLNLLVREGVAANGNTVRIDVFQVPDDGYYFIPVYVADTKKAMLPSKAVVAHKPYDQWKEMSGQHFIFSLYPGDLIRIRSRKGIKLKLAKGGTGESEISRQDGLYYYRGGDISTGAISISTHDRRYESRGIGIKTLQSIEKYQVDVLGNYHKVNLPEKRIPFTKEG

SEQ ID NO: 7732 - protein, 1130 aa, unidentified
  REGION 1..1130: note = Description of Unknown:uncultivated organism sequence
MGYRIGLDLGITSVGWAVLEDDKDGNPRRIIDLGTRIFDAAENPKDGSPLAEPRRNARSLRRRLRRKSHRVKRTKQLLEKYGIITQEEIENMYKTYNFQFTPYELRVDALDNKLTNSELARVLISMAKKRGYKSNSKAEENTSGSDAGKLLTATKENEELMKVNGYRTVAEMYLNDRRFKIIMPDGSEMIKIKNSPNEYRNTPLRKLLVEEIKLILNKQKEFNNLITDEFISDYLEIFESQRNFDEGPGDGPYSGNQIEKMIGHCTFEPNEIRAPKACYTFEYFKLLQDINHIKIERINEDNRVEKRELSEEERNQIIELAKRQVTITYDTLRKVLNLEDNERFNMVNYEKVYSSDKEDIKKSEKGRKSDELKSYHEIRKALDRVEKDYINNLSWDELDVIGYGLTTFKSDEKRLNYFKENNLKIKEDFINELLKLSFSKYGNLSIKCMKNIIPHLEKGLTYDKAVGQVYPDHRGIINTTKKTKLSLNDLEERITNPVVRRAVSQTIKVINAINNKYISLYGKPDAVVVELARELGKSKNERNNIQKNQESNRALNERVKREIEKLGKPNVTGQDIVKYRLWQEQDGRCLYSGKAISPEDLFTEAVDVDHIIPYSMCYDDSYNNKVLVLSSENRQKGNRIPYEYIKESGRNIEEYEVRIDAYVRSYQKKRRLLKESYSRDDIEEQKERNLNDTRYITKTITKLINNYMEFSDKVEYKRRVLTVNGRITAYVRRRLGIEKIRANGDEHHAVDAAVIAVISQKFINSITRFAQYMDARRMKNTGEYIDYETGEIVNAKEFEEKYGTRFPEPWDKFRKELEIRSSIETKERMEDVIKAEKIMSYYEHDDGIDRFEDLEPIFISRMPRRKVKGEVHKETIRGLKKENGIIKTVTKTDLVNLKLDNKGEIKNYSEKAKKDDRLLYEALREQLQKHGGDGKEAFKEKFYKPKSDGTKGPLVKKVKLEEKTTLGVELNNGRAIADNGGMVRIDVFYVENEGYYFVPIYIADTLKEKLPNKACIPGKNYEDWKEMDEKNFIFSLYPNDLIRIVGNGKIKLNGNKDKEKDSIEVDELFAYYIKAGISVASITIVNHDSEYIQPNLGIKSLKSIEKYTVDVLGNYNKVKLPEKRQKFNIK

SEQ ID NO: 7733 - protein, 1169 aa, unidentified
  REGION 1..1169: note = Description of Unknown:uncultivated organism sequence
MGYRIGLDLGISSIGWACVEDKENGEPKRIIDLGTRIFDRAENPKDGAPLAAPRREARELRRRLRRRNHRIKRTKILLEKYDIISQQEIEKMYENYNFPNTPYELRVIGLDNKLTNKELARVLISLVKKRGYKSNSKSEESNDKETGKLLTATKDNENLMKEKGYRSVAEMYLKDEKFKMRLPNGQIATRIDKNTGKEIEIIKIKNSINDYKNTPLRKLLVEEIKLILNKQKEYNPKITDQFINEYLNIFTSQRNFDEGPGEPSPYAGNQIEKMLGKCTFEREEYRAPKSTYTFEYFKLLQDLNHIKIIQYELKQDNEIVQTVRTLTEEERKKLIELAKKTPTLNYYKIRKEIKLKENERFNMCRYKSTREFTDDVNKEAESDNKKIKEFQSYHEIRKALDKYEKEYIQKLSTNDLDNIGYALCVYKNDKKRIEYIKTNVTQIPDEVINYLLPLSFSKVGNLSLKAMKKIIPYLEKGLTYDKAVNELGKIDSNYSDFRGIVNTEKRRKLSINNLEENISNPVVRRAVSQTIKVLNAITLKYNSIYGKPDLVVVELARELGKSFKERQSIEKIYEENRTRNEKTIQEIRELGKTNVTGKDIVKYKLWKDQNEICIYSGKHIKVEDLFTDAVDIDHIIPYSQCFDDTYKNKVLVLASENRQKGNRTAYKYIKEAGKNLEEYEVRVNNYIKDYRKKERLLKADFSTEDVKNWKDRNIEDTQYISRLVYKLINNYMEFSDNPNINRKVRNINGAVTHYIRNRLGIEKIRADGDEHHAVDACIIATTSNYMVNKITRYSQYIDGRFMNDRGEYVDIETGEIINKEDYEEEYGPKFPEPWEGFRRELEIRSSDDVANRAEKAPEELKNIMIQEINDEIKKGKLYSYIEHDDGINRFDDIEPIFVSRMPRRKVKGQAHMETIRGIEKENGKLKTITKTPLTKLKLDDNNEIKNYSKKAKQDDKLLYDALVEQLKKFDGKGEEAFKEPFFKPKKDGSKGPIVNTVKIEENATLGVEFKEGKAFAGNGNMVRIDVFYVEGEGYYFVPIYVANTIKKELPNKACVANKGTDKWKTMDDKNFIFSLYPNDLIYIESEKGIKLNGNNDNKKEQIEVKKLFAYYVKAGISVAQITIDNQDGEYTQPSLGIKGLKKIEKYDIDVLGNYHKIKLPEKRIKFNIN

SEQ ID NO: 7734 - protein, 1372 aa, unidentified
  REGION 1..1372: note = Description of Unknown:uncultivated organism sequence
MADKNKKMYVGIDMGTNSVGMAVTDEHYDLYRVKGKDYWCSRTFSSADTAVERRMNRISRRCRQREVARLGTLRELFSEEIQKVDEGFFARLDESRYYLEDKENKQPYALFADTGYTDKEYYKDYPTIFHLRKELIESDQPHDVRLVYLAIANMYKHRGHFLNDSLSSDQTLSNIEDAYQNLVDEAAMFGIYFPESVNVKVLESKIGEKGIAKKQILANVCEFLEISKRESKQAYELLCLICGMTGKLINIYGEEAIGEDNKSFSISFRDSNYEDKEAQTKEILGEEYFALLQAAKELHDIGLLSAIMKGCKYLSEARVAQYEEHRHDLKLLQSVLRKYDKSEYDKMFRTMEDGNYSAYVGSVNSSTEKVRRNGGKGRTRDDFYKNVKKVLAKFPQEDVDIRYIQEKIENETFMPKQLTFANGVIPNQLHASEMKAILNQAEKYLPFLSAKDESGLTVSQKILQLFTFKIPYYVGPIGQNHIGDKNSNVWAKRRPGEEQGKVYPWNFEQKIDTKAAAEAFIERMVRPCTYLKGQNTLPKCSLLYEKFMVLNELNNLRINGEKPSVSVKQLIYQELFEKGKRVTLNQLKEFLYHHSIVASKEETVITGISDGFNSSLTSVGKFRGIFGDQVLTDHNRKMIEKIIFWGTIYGNDKKFFRERMEENYGDELSREEIKRIAGFKFNGWGNLSKEFLELEGSCECGECSLIQAMWNTNHNLMELLSDQYTFFDSLKKRTKEAYRPLAEWTIEDLDGNYLSAPVKRMVWQTIKMLREVQETTGKEPDKIFIEMTREHGEKGKQTVSRKKKLLSLYQSIQKEQQAWVKSKIIEIDGKPEADFKIKKLYLYYLQLGRCMYSGSEISLDDLMNDNLYDIDHIYPRHFRKDDSIENNLVLVKKEINNHKQDTFPLEHELQSARMPYWKSLVERGFITKEKYNRLTRKDAFTPEEKAEFINRQLVETGQGTKTITQILQQAFPNTKIVFVKAAVVSDFRKKFSLLKVRALNDTHHAKDAYLNIVAGNTYDTKFTNHPLNFIKEAEKRGTSYHYHMDKIFDYNVERNGERAWIADHSESISKVKKTVGRNTVLITKKTEEVHGALSNKATIWGKNVAKKDVYLPVKSTDVRASDVTKYGGITAIANSGYTLVEYQVNDKIIRSLEALPVSLGRAEQLTEDAVLQYIIPVLQREHKKKKVEHVRVCQLFIPQKSKVKIDGFDYYLGGKSGNSIYLTNAVPLYLAPTDEEYLRKLLKGLEKNDYQEIDKDHNLILTPEKNMALYRALMQKLQGNPFVHNKWNIYRTLEGKEAVFAGLNMENQCYVVNQILMWITSSTQSVDLQLMRGSKHSGIMLMNKKISVAKEFVLIHQSVTGIYETKTDLLLV

SEQ ID NO: 7735 - protein, 1377 aa, unidentified
  REGION 1..1377: note = Description of Unknown:uncultivated organism sequence
MGKKMYVGLDMGTSSVGLAVTDENYKLYRVKGKDYWCSRTFDEADTAVERRTNRISRRRRQREVARLGILRELFADEIAKVDPGFYARLDESKYHLEDRDNKQPYAIFSDKGYTDKEYYAQYPTIFHLRSELIDSDKPHDVRLVYLALANMFKHRGHFLNDSLSSDKPLADTTEAYSNFYYTASELSISFPAEAQPDSIDAASLEALLGDKGVSRTDKAKNICQYLAIDKKTSKPLYTLINLICGLNIKLIDIYGAELIDEENKKLSIGFRDSSYEQQDADGRKLLGENYAIIDAAKELHDIGLLSSIMKGYKYLSQARVALYEEHAADLKKLKSVLKRYDKDSYRKVFRSMDEGSYSAYIGSVNSGTKIRRGVKDGSADTFCKSMKKVLEKLPKDDMDVQYLLAKATDSSLLPKQLTFENGVIPNQLHAAEMKAILRQAEKYLPFLLEKDEYDLTVSQRIIQLFTFRIPYYVGPIGKNHAGEKGYNIWATRRAGEEDGRVYPWNFEQKIDTKAAAEKFIERMVRHCTYINGERTLPKCSLLYEKYMVLNELNNLRIKGEKPAVSVKQDIYTKLFCRGKRVTMKMLKDYLYNSSLIPSKEDVVISGIDNGFNTSLTSVGKFRGILGDAVFADSNQKMIEDIIFWGTVYGNDKKFLKERIEEVYGDRLNQDEIKRILGFNFNGWGNLSREFLELEGECECGRCSIIQAQWNTNHNLMELLSDQFTFKNELEKKTGSAEKALADWSIDDLEGKYLSAPVKRMIWQTIKMLREVCEVTGRTPDKIFVEMAREDGEKGARTVSRKKKLLDLYDAIKHEERELAKVFSDEIDSKTEADFRSKKLYLYYLQQGRCMYSGDIIHLSDLMNDNLYDIDHIYPRHFIKDDSLENNLVLVKKQINNRKQDTFPIERSIQEDMRPFWKSLADSGFISAEKYKRLTRRDAFTDEEKAAFISRQLVETRQGTKAIADILKQALPDTEIVYVKAGLVSDFRQKFELYKVRALNDTHHAKDAYLNIVVGNTYSTKFTNNPLNFIKAGAKRPQDNQFKYNMDKIFDYNVISRGERAWIAGSDGSICTVKKFMSRNTVLITRKAKEVHGALSNKATIWGKNVAKPGAYLPVKSTDLKAQDVTKYGGITSIANSGYTLAEYKVNGKTTRSLEALPVYLGRAEQLTEKTVVDYLSSSLQESSKKKIEDIQVRKLFIPQGSKVKIDGFCYYLGGKTGDSIYLNNAVPLYLSSTSEEYLRKLLKAVENNNYNERDKNGQIILTAPKNVQLLSSIFDKLRSKPFSNNKWNIYFSIVNGKETKVEQLFSKLSIDKQAEVISQIVIWINSSRQNVNLSLIGGSAHSGTQALSKTVSRLNECMLISQSITGIYEHSVDLLTI

SEQ ID NO: 7736 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDKFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7737 - protein, 1383 aa, unidentified
  REGION 1..1383: note = Description of Unknown:uncultivated organism sequence
MKKILGLDLGTSSIGWALVNEKESQDEQSSIIKLGVRVNPLTVDEQRNFEKGKSITTNADRTLKRSMRRNLQRYKLRRENLIRLLRDSRIISFDSVLAEEGNSTTFETYRLRAKAATESISLEEFARVLLMINKKRGYRSSRKAKSTEDGQLIDGMEVAKQLYDNNLTPGQFAYNLLNNGSKYIPDFYRSDLQNEFDRIWSTQQNFYPQILTDELKSELNNKNEKQTWAICEKPFNIVGIKRTTKGDELKKENYKWRVESLSQKIDLEELSIVLQKVNSQIKNSSGYLGEISSRSKELFFNNQTVGQFLMSELEKNPNYSLKNQVFYRQDYLDEFEKIWETQALYHKELTHKLKKEIRDIVIFYQRPLKSQKSLISICELESKQIEVEIDGHKKVITVGNRVCPKSSPLFQEFKIWQILNNILVTNKNNSNTWLLEEEEKRKLFEELNIKDKISKIEALKLLYKNYKELDLNYKEIEGNRTNSALFKAYQTIIERTGHGEYDFTKLPSIQTMEIVESVFGSLGFNTEILHFDSSLEGEDFERQPSYQFWHLLYSYEGDDSKLGNAKLIDKITELYGFNKDYSSILANVPFLQDYGNLSTKAIRKVLPYLKDGCEYSQACEYAGYRHSKRSLTKDEINSKNLKNRLDILPRNSLRNPVVEKILNQMINVVNTIVDEYGKPDEIRIELARELKKSALERERMTDAISKSTIEHDYYRSILQKEYGLKNVSRNDIIRYKLYLELKDNGFKTLYSNTYISQEELFSKKFDIEHIIPQSKLFDDSFSNKTLEDRNINIEKSDATAYDFVLAKYGDKGAEEYKMRIDTLFHKGIIGKTKRDRLLTKESDIPSGFISRNLRDSQYIAKEAREILEDIVPSVVPTTGSVTDRLREDWQLIDVIQELNWNKYDKLGLTEVIEDKDGKRIRRIKNWTKRNDHRHHAMDALTIAFTKRSIIQYLNNLNAKSDKSSSIYGIEKNELCRDSHGKRRFIPPMPLDDFRAEAKKHLDSIIVSVKAKNKVVTKNVNITKKKNGVSNRTIQLTPRGQLHNETVYGRIKRYVVKEEKVGSAFDAIKISSVAVQKYRELLMERYNSFGKDAKKAFTGKNSLEKNPIYVDDNHTKTIPVKVKIVSFENIYTVRKSVSPDLKIDKVIDSKIKRILEARLKEFGGDSKRAFSNLDENPIWLNKEKGISLKRVTISGVSNAEAIHTKHDNKGKDIIDDCGNTMPSDYVSTSNNHHVAVYRDAEGNLQEKIVSFYEASIKAILGEPIVDVNYNKTEGWQFLFTMKQNEYFVFPNAETGFDPNEIDLLNPNNYAAISPNLFRVQTMSKVTYGNTIVRDYKFRHHLETTVDDSSSLKNITYKQYKTLDFAYGIVKVRVNHIGRIVSVGE

SEQ ID NO: 7738 - protein, 1374 aa, unidentified
  REGION 1..1374: note = Description of Unknown:uncultivated organism sequence
MKKILGLDLGTSSIGWAVVNEAENSNEQSSIIKLGVRVNPLTVDEQRNFEQGKSITTNADRTLKRGMRRNLQRYKLRRDNLIDCLKEHGFIDNETELCENGNQTTFQTYRLRAKAVTERIALNELARVFLMINKKRGYKSSRKAKSMDEGQLIDGMSIAMQLYNENITPGQLLLSLLEKGKKHIPDFYRSDLQDELERIWKYQQLFYPEILTDEFREQIHGKGKQNTSKIFLGKYNIYTADNKGKDKRLQSYRWRSDALSKKLSIEELAYVISEVNGSINNSSGYLGAISDRSKELYFKKLTVGQYLMNELDKNPHYSLKNQVFYRQDYLDEFEAIWEVQATFHKELTPELKKEIRDIIIFYQRPLKSQKGLISYCEFESRQMEVTVDGIQKLKTVGYKVCPKSSPLFQEFKIWQVLNNLQVIDRTTKEKRPLYQDEKETLFSELNIKEKLSKTEVLKLLYKNYKDLDLNHKDVEGNRTTAALFKAYNSIISMSGNGEYDFVKMPATDIVNTVTEIFKGLGYSTEILSFNSGIEGKEFEKQPMYRLWHLLYSYEGDNSNMGNEGLINKITELYGFEREYAVILANVVFQPDYGSLSTKAIRKVLPYMKEGNEYSIACGYAGYRHSQRSLTKEELDAKEYKDYLELLPRNSLRNPVVEKILNQMINVVNSVVTTYGKPDEIRIELARELKKSAKEREEMTAAINKSTTEHEKYREILRKDFGLVNVSRNDIIRYKLYKELESNGFKTLYSNTYIPQEKLFSKEFDIEHIIPQAKLFDDSFSNKTIESRAVNIEKSNATAYDYVADKYDEKALLDYETRIENLYRSGVIKKSKRDKLLMKEADILSDFIERDLRDSQYIAKKAREILEELVKFVVPTTGSITDRLREDWQLIDVMQELNWDKYDMLGLTEIKEDKDGRTIKRIKDWTKRNDHRHHAMDALTIAFTKRSIIQYLNNLNARSDKSSSIFAIEQKELYRDKRGKLKFEPPMKLDEFRTEAKKQLENILVSIKAKNKVVTQNVNRSKCKNGNKTKIQLTPRGQLHNETVYGSIRRYVTKIEKVGANFNAEQIAKVANKKYRDALFNRLALFNNDPKKAFTGKNSLEKNPIYLNELHTDTLPSKVKTVTLEVLYTIRKEISPDLKLEKVIDAGIREKLEKRLKDFGGDSRKAFSNLSENPIWLNEEKGISIKRVTITGVSNAIALHDKKNHLGEFLLDSEGKKQPVDFVNTGNNHHVAIYRDEKGQLQEDVVSFYKAITRASLGLPVVDKEYKKSEGWEFLFSMKQNEYFVFPNEKTGFNPDEVDLMNPDNYALISPNLFRVQTIASKDYRFRHHLETKVEDNKKELQDITWKRIRSLGYLNNLVKVRVNHIGQIVSIGEY

SEQ ID NO: 7739 - protein, 1419 aa, unidentified
  REGION 1..1419: note = Description of Unknown:uncultivated organism sequence
MKKVLGLDLGTASIGWALVNENENEKSSIIKVGVRVNPLTVDELTNFEKGKSITTNADRTLKRSMRRNLQRYKLRRENLIEVLKSYGFITDSSVLTEQGNATTFQTLRLRSTAASEKISLDEFARVLLVINKKRGYKSSRKVNSDEDGQLIDGMSIAKQIYEEDITPGQYEFSRLKEGKKGRLDFYRSDLQNEFDIIWNKQATFYQEILTESLKESLKGKNRTQTWAICAKPFGIVGIKRAKKGVELMLENYEWRVKSLFEMIGLEQLAIVFQEINGEINNSSGYLGKISDRSKELYFNHQTVGQYQMSELDKNPHYSLKNQVFYRQDYLDEFEKIWETQAKYHKELTDERKKEIRDIIIFYQRPLKSQKGLISFCELESKQIEVMIDGKSKIKTIGSRVCPKSSPIFQEFKIWQRLNDAEVIGNIIPSGEEELFENPNIYKKGKRPLTQEEKEILFDELSIRDKMLKNDVLKLLFTNYKDLDLNFKELEGNRTQAALYRAYETIIEQTGHDAINFNNMSASQIKETVSAIFKGLGYKTDFLQFASCIDGDSFEQQPLFRLWHLLYSFEGDSSITGNEQLIKKIQSICGFEQEYSKIISNIKLQDDYGNLSTKAIRKILPFMKEGNKYSEVCVYAGYNHSKRSLSKEEIENKKLLNHLDLLAKGSLRNPVVEKILNQMINVINEIIENYGKPDEIRIELARELKKNAKEREDAIEAINKNTSLNESIKKELEEDFGFKNVSRNDILRYKLYQELKNNGYHTLYSSTYIPKDKVFSKEFDIEHIIPQAKLFDDSFSNKTLESKSINIEKSNMTARDFVLKKYDNNGLEEYIARIEKLYKDNTLSKGKYRKLLMSEADIPSGFIDRDLRDSQYIAKKAREILESIVKVVVPTTGSVTDRLREDWQLIDVMKELNWDKYSKLGLTETITKRDYDGNQYTIKEIKDWTKRNDHRHHAMDALTIAFTKHSFIQYLNNLNARVGRDNLLLGNIAADKADRSRDIYAIESKELYRDSKNNLRFNPPMPLNEFRAEAKHQLQNILVSIKSKNKVVTRNINTTKKHGGVSKRVQLTPRGQLHLEKVFGSQKIYTTRMEKIGASFNETKILTVANKRERDALFVRYIEFDRDAKKAFTGKNSLDKNPIYLDSAHSYKLGVSVKTVSLDTIYTIRKEIGPDLKIDKVIDPVIQGILNQRLEEYGGDFKKAFTNLDDNPIYLNKEKGITVKRVTITGINKATSIHFRKDSFGNSITDNDGKKIPVDFVNTGNNHHVAIYRDENGELQENVVSFYEATKRATEGKPIIDRDFNKSKGWHFLFTMKQNEYFVFPKYETVKDQAVDEKTVMSFNPMNIDLLDPANYSIISPNLYRVRKISTKDYCFRHHLETTVTEDKNLRDTTWKRIQNPGDLNAIIKIRVNHIGQIVQVGEY

SEQ ID NO: 7740 - protein, 1372 aa, unidentified
  REGION 1..1372: note = Description of Unknown:uncultivated organism sequence
MKKILGLDLGITSIGWALVNEAENENEASSMTKLGVRVNPITVDELTNFEKGKSITTNADRTLKRSMRRNLQRYKLRRENLVQILKAHRFITEETILSEDGNRTTFETYRLRAKAATQQITPEQFGRVLLMINKKRGYRSSRKVKSQDEGQLIDGMAIAKRLYNEGITPGQLTYQLIKEGKKQTPDFYRSDLQSELDKIWNYQKQYYPEILTDEFRLQISGKGKLNTTKIFLGKYGIYTAENKGTDKKLQATQWRVDAFTKQLPKEEMAFVISEVNGAISGSSGYLGAISDRSKELYFNKQTVGQYLMAQLDKDPHFSLKSQIFYRQDYLDEFECIWETQTKFHKQLTPELKSEIRDIIIFYQRRLKSQKGLIRFCEFESREIEVEIDGRKKVKTVGSRVCPKSSPLFQEFKIWQILNNIEVKNKKDGTVRLLFQDEKETLFEELSIKEKLRKDEALKILYKNHKELDLNFPTIEGNRTQAALFSACETIIDLSGHGQYDFSILRSSQIIELVESVFTAIGYNTEILKFNSALEGDSFEKQPLYRLWHLLYSFEGDDSRTGDEKLIEKLCELYNFSKEHAIIIANIALQDDYAGLSAKAIRKILPHLKEGLGYDIACLNAGYRHSKESLTKEEIENKILKDKLDILPKNSLRNPVVEKILNQMINVVNEIVKHYGRPDEIRIEMARELKKSAKERESMTSAINKSTAEHEKYREILRKEFGLSHVSRNDIIRYKLYLELEHRGYKTLYSDTYIPREKLFSKEYDIEHIIPQSRLFDDSFSNKTLEVRSVNIEKGGETAYDYIFGKAGETGLNEYLGRIESLYKADKISKTKYNKLKMTGGDIPADFIDRDLRDTQYIAKKARNILQTLVKTVTPTTGSVTDRLREDWQLIDVMQELNWDKYEKLGLTEIFENRDGQRIKRIKDWTKRNDHRHHAMDALTIAFTKRSHIQYLNNLNARSDKAGSIYGIETKELYRDDRGKLKFKPPIPINEFRAVAKEHLEGTLISIKAKNKVVTKNINITKKKGGLNKKIQLTPRGQLHLETIYGSSQQYITKDEKVSASFDESQILRVAKKSHREALLSRLRQFDNDPKKAFTGKNSPAKNPVYLDADKTIELPEKVKIVTTETIYTIRKEITPDLKIEKVTDVGIRKILEVRLKEYNNERKLAFANLDENPIWLNKEKGIAIKRVTITGVNNAQALHDKKDKHGNLMPDNNVNPQPVDFVNTGNNHHVAIYKDENGNLQENVISFFEATTRASLGLPIIDKTYKTDEGWQFLFSMKQNEYFVFSNDKTGFNPKEIDLLNPDNYHLISPNLFRVQKFTTKDYVFRHHLETTVESHNLLKDITWLRLGINGIRNVTKVRVNHIGLIVSVGEY

SEQ ID NO: 7741 - protein, 1390 aa, unidentified
  REGION 1..1390: note = Description of Unknown:uncultivated organism sequence
MKKILGLDLGTGSIGWAVVNEKDKEGESSSIVKLGVRVNPLTVDEQTNFEKGKPITTNADRTLKRGMRRNLQRYRLRRDCLVKLLKDNGWINDDTILAEHGNSTTFETRRLRAKAATEEISIEQLARVLLMINKKRGYKSNRKAKQDGEDGRLIDSMDVAKKLYDENLTPGQYVLSLMKEGQKYVPDFYRSDLQEEFDRIWNFQQQFHPDILTDSLKSELHDKNKSQTWAICAKPFCIKGIKRETKGWEQKKENYVWRDEALKRQMDFERLAVVLQEVNGQIKNSSGYLGAISDRSKELYFRGMTVGQYQMAELDEDPNHSLKNEVFYRQDYLDEFERIWETQAKFHKELTPELKHDVRDTVIFYQRPLKSQKGLISFCEFESREVEVDVDGKKKTRTVGLRVCPKSSPLFQEFKLWQVINNVQVSGPIVPEAQPDLFGMSASYKYGKRFLEQREKETLFKELSLREKMNKKDILKLLFKNYSELDLNYKEIKGDTTRAALLKACQSILEMSGHGTYDFAKMSADEIMSIIEPVFKMLGINTGILHFDSSLEGKAFIAQPAYRLWHLLYSYEGDKSKTGNEKLVEKISSLFGFSREYAEVIASLTSDSDYGSLSAKAMRKILPYMREGVEYSEACRLAGYRHSARSLTREELDSKPLKDRVDLLPRGSLRNPVVEKILNQMINVVNSAIKTYGRPDEIRIEMARELKKTAAQREDMVKAIKKVSDANEEYRKTLQEEFGIPNPSRNDIIKYRLYLELKENGYKTLYSNTYIQRERLFSKDFDVEHIIPQAKLFDDSFANKTLEARSANLEKSNLTAFDYVKGKYGEAGLDDYKKRVEALCDKGAISKTKRKRLLTTEADIPDGFINRDLNDTQYIARKAREILEEVVRTVTATTGSVTDRLREDWQLVDVMKELNWDKYDRLGLTEIVTDRDGRRIRHIKDWTKRNDHRHHAMDALTIAFTKPSFIQYLNNMNARSDKGGSIYGIERKELYRDGNGKLRFCPPMPLDEFRAEAKRQLEGVLVSIKAKNKVVTRNVNITKEKKGKHEKVQLTPRGQLHNETIYGCIRRYNPQYEKVNASFNEEKIKTVAVKRYREALLERLRLCYGDPKKAFTGRNALDKNPLFTDKTHTEKVPLKVKTVTLETVYTQRQEVNKDLNLDKVVDKKVKTLLEERLQQYGGDKVKAFSNLDENPIWLNKEKGIQVKRVTITGKSNVVALHDKRDNLGRLILDKDGNKQPVDFVSTSNNHHVAIFRDVEGNLQEHVVSFYEATARAIQHLPVIDKDYKKDEGWQFLFTMKQNEYFVFPNSGTGFDPKEIDLLDPRNYAEISKNLYRVQKLSLKDYVFRHHLETTVSDKKEMSGITWKRCGLSGIKGIVKVRVNHLGQIVSVGEY

SEQ ID NO: 7742 - protein, 1391 aa, unidentified
  REGION 1..1391: note = Description of Unknown:uncultivated organism sequence
MKKILGLDLGTGSIGWAVVNEKDKEGESSSIVKLGVRVNPLTVDEQTNFEKGKPITTNADRTLKRGMRRNLQRYRLRRDCLVKLLKDNGWINDDTILAEHGNSTTFETRRLRAKAAAEEISLGQLARVLLMINKKRGYKSNRKAKQDGEDGRLIDSMDVAKKLYDENQTPGQYVLSLMKEGKKYVSDFYRSDLQEEFDRIWNFQQQFHPDILTDSLKSELHDKNKSQTWAICAKPFCIKGIKRETKGWEQKKENYVWRDEALKRHMDFERLAVVLQEVNGQIKNSSGYLGAISDRSKELYFRGMTVGQYQMAELDEDPNHSLKNEVFYRQDYLDEFERIWETQAKFHKELTPELKHDVRDTVIFYQRPLKSQKGLISFCEFESREVEVDVDGKKKTRTVGLRVCPKSSPLFQEFKLWQVINNVQVSGPIVPEAQPDLFGMSASYKYGKRFLEKEEKDVLFKELSCREKMNKKDILKLLFKNYSELDLNYKEIKGDTTRAALLKACQSILEMSGHGTYDFAKMSADKIMSIIEPVFKMLGINTGILHFDSSLEGKAFIAQPAYRLWHLLYSYEGDKSKTGNEKLVEKISSLFGFSREYAEVIASLTFDSDYCSLSAKAMRKILPYMREGVEYSEACRLAGYRHSARSLTREELDSKPLKDRVDLLPRGSLRNPVVEKILNQMINVVNSAIKTYGRPDEIRIEMARELKKTAAQREDMVKAIKKVSDANEEYRKTLQEEFGIPNPSRNDIIKYRLYLELKENGYKTLYSNTYIQRERLFSKDFDVEHIIPQAKLFDDSFANKTLEARSANLEKSNLTAFDYVKGKYGDAGLEDYKKRVEALCDKGAISKTKRKRLLTTEADIPDGFINRDLNDTQYIARKAREILEEVVRTLTATTGSVTDRLREDWQLVDVMKELNWDKYDRLGLTEIVTDRDGRRIRHIKDWTKRNDHRHHAMDALTIAFTKPSFIQYLNNMNARSDKGGSIYGIERKELYRDGNGKLRFCPPMPLDEFRAEAKRLLEGVLVSIKAKNKVVTRNVNITKAKKGKHEKVQLTPRGQLHNETIYGCIRRYNPQYEKVNASFNEEKIKTVAVKRYREALLERLRLCYGDPKKAFTGRNALDKNPLFTDKTHTEKVPLKVKTVTLETVYTQRQEVNKDLNLDKVVDKKVKTLLEERLQQYGGDKVKAFSNLDENPIWLNKEKGIQVKRVTITGKSNVVALHDKRDNLGRLILDKDGNKQPVDFVSTSNNHHVAIFRDVEGNLQEHVVSFYEATARAIQHLPVIDKDYKKDEGWQFLFTMKQNEYFVFPNSGTGFDPKEIDLLDPRNYAEISKNLYRVQKLSTKNYFFRHHLETSVEDKKELKGIAWKNIRTPEGLGELVKVRVNHLGQIVSVGEY

SEQ ID NO: 7743 - protein, 1390 aa, unidentified
  REGION 1..1390: note = Description of Unknown:uncultivated organism sequence
MKKILGLDLGTNSIGWALVNEKENENEKSSIIKLGVRVNPLTVDEQRNFEQGKSITTNADRTLKHGMRLNLHRYKMRRDALLETLKDNGFITDDTILSENNRIVFETYRSRAKAATEQVSLEDFAKILLMINKKRGYKSSRKAKSDDEGTAVDGMDIAKQLYDNDLTPGQFTLSLLKQGKRNVPEFYRSDLVLEFNRIWYFQMQFYPQFLTEELKKELENKNRNQTWAICAKPFYLVGIKRTTKREEQKLENYEWRVKCLSEKVDLEVLAIVLQEINGQINNSSGYLGNISDRSKELYFKKLTVGQYLMEKLSANPHFSLKNIVFYRQDYLDEFERLWEVQSQYHKELTPDLKHQIRDIIIFYQRPLKSQKGLISLCEFENRTIEINVEGKKKTKTIGLRVCPRSSPLFQEFKIWQVLNNIQVSGSIIPDVQKDLFGETKEYKYGKRFLYQEEKELLFKELNYKEKLSKTEILKLLFKNYKELDLNFKENIEGNKTNAALYNAFQKIIDITGHGEYNFSKMQADEIISIVEPVFKGLGFDTSILHFDASLEGKDFEKQSAYQLWHLLYSFAGDNSKSGQDTLVNKICERFGFDKECAKVLAAVNLQSDYGSLSAKAIRRILPHMKDGLEYSAACEYAGYRHSKRSLTKEELQNKELKDKLELLPRNSLRNPVVEKILNQMINVVNNVILTYGKPDEIRIELARELKRNAKEREEMTKAINAATTEHENYRKILQDEFGIVNPSRNDIIRYKLYLELKDNGFKTLYSNTYIPQEKLFSKEFDIEHIIPQAKLFDDSFSNKTIEVRSINIEKSNATAMDFVEGKYDEKEVISYKVRVEELYKNGVISKTKHDKLLMREKDIPTGFIERDLRDSQYIAKKAREILEDIVRVVVPTTGSVTDRLRDDWQLVDVMKELNWQKYDKLGLTEIREDRDGRKIKHIKDWTKRNDHRHHAMDALTIAFTKQSIIQYLNNLSARSDKSSSIYAIEQKELYRDQHGKLRFYPPIPLDEFRDVAKKMLEQILVSIKAKNKVVTRNINTTKNGNGKRNKKVQLTPRGQLHNETIYGKIQQYVTKEEKINASFNAEKIATVANQRYRLALLERLNEYGGDAKKAFAGNNSLSKKPLFLDAMHTQSVPEKVKTVAFEDVYTIRKEITPDLKLDKVIDVKIRRVLEARLKEYDNNAKKAFSNLDENPIWLNKEKGISIKRVTIRGVSNAVALHDKHDHNGELILDKNGHKQPSDYVSTSNNHHVAIYCDADGNLQENVVSFYEATMRANQGMPIIDKTYRKNEGWQFLFTMKQNEYFVFPNPETGFNPNDIDLLDSKNYHLISPNLFRVQKLATKDYWFRQHLETTVENKKELFEITWKRITALNNLIGIVKVRVNHIGQIVSVGE

SEQ ID NO: 7744 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCKGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNISLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFECQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLAKYGEHGDNGSIKYRERIDTLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLAEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERRIAIKRVTIYGVSNATALHDKRDMHGKKMLNSNGISIPVDFVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7745 - protein, 1392 aa, unidentified
  REGION 1..1392: note = Description of Unknown:uncultivated organism sequence
MKRILGLDLGTSSIGWALVNESEDEREQSSIIKLGVRVNPLTVDEQRNFEAGKPITTNAERTLKRSMRRNLQRYKLRRDNLIEILTEHGFITPETILAEQGNKSTFETYRLRAKAVTEEISLEELARVLLMINKKRGYKSSRKLDTNEDGKIIDGMEVAKQLYDEGLTPGQYMLRLMDSGKRYTPDFYRSDLKDEFGRIWDFQKTFYPELLTDELRQELAGKNEKQTWAICAKTFSLVGLKRTAKGEELKRENYKWRVDSLSEKMDLESLTVVLQKINGQINGSSGYLGEMSDRSKELYFKKQTVGQYLMSRLDKNSHYSLKNKVFYRQDYLDEFEMIWENQARYHSELTDSLKHEIRDVVIFYQRSLKSQKGLISFCEFENRQMETVKYGKKRLKTVGLRVCPKSSPLFQEFKIWQILNNIQVSGKVVRKQSVDLFGETVEMANGKRFLYQEEKEKLFRELNIKAKMSKAEVLKLLFKNHKELDLNYKEIEGNRTQAALFAAYQTIIDMSGHGTHDFSKMCADDVMDIVSNVFGGLEFGTDILCFDSSLEGKAFERQPAYRLWHLLYSFAGDNSKTGNEKLISKISELYGFDREYAAIIAGISFQLDYGSLSAKAIRKILPYMKEGNEYSVACGYAGYRHSKNSLTKEELANKLLCNRLKPLPRNSLRNPVVEKILNQMINVVNSVANVYGKPDEIRIEMARELKNSAKEREEMTKAISKATADHEYYRQILKNEFGIENVSRNDIIRYKLYMELKDKGFKTLYSNTYIPREKLFSKEFDIEHIIPQARLFDDSFSNKTIEVRSVNIEKGNMTAYDYVCGKYDADKVSAYKVRVEELFKNGTISKTKRDKLLMSEADIPSGFIERDLRDSQYIARKAREILESLVRTVVPTTGSITSRLREDWQLVDVMKELNWDKYNRLGLTDFVVDKDGRRIRRIKDWTKRNDHRHHAMDALTIAFTKPSYIQYLNNMNARSDKGSSIYAIEKKELYRDNGKLKFQPPMPLDVFRAEAKRHLDGILVSIKAKNKVVTRNTNVSKIKGGTKKKVQLTPRGQLHNETVYGRIKRYVVKEEKVNASFDMQKIDTVANMRYRMALSDRLQQYGGNAKKAFTGSNSLQKNPLYVDDMHIIAVPERVKTVGFEYVYTIRKEVTPDLKIDKVVDSKVRNILKARLEQFGNDAKKAFVNLDENPIWLNKEKGIAIKRVTITGVSNALALHDKRDNSGKPMLDVNGHKMPVDFVSPSNNHHVAIYMDADGKMQDDIVSFYEATMRANQGYPVIDRDKNRSEGWQFLFTMKQNEYFVFPNEETGFDPNEIDLLDPNNYPIISPNLFRVQKLSKTEGRIYMFRHHLETTVDDKKELQEVTWKRINSLDKLKNVVKVRVDHVGRIVSVGEY

SEQ ID NO: 7746 - protein, 1393 aa, unidentified
  REGION 1..1393: note = Description of Unknown:uncultivated organism sequence
MENVKHTSMKKILGLDLGTNSTGWALVNEAENTAEKSSITKLGVRIIKYDNFVNTETGSESKEPEKDFCGGKGISPNAGRTKGRSARRNLQRYKLRRANLIEYLKKCGLITDSAVLCENGNRTTFQTYRLRAMAVTEEISLEELSRVFLMINKKRGYKSSRKAKLPDEGQLIDGMAVAEQLYENDLTPGQFVFSILQQGKKSIPEFYRSDLQNELNRIWDHQKQFYPEILTDEFRKQIEGEGRPNTAKMFLGKYKIYTADIKGKDKRLQAYQWRSNALTSQLSIDEVAFVVSELNGAINNASSYLGAIGDRSKELRFNKLTVGQYLMKQLDKDPNYSLKNQVFYRQDYLDEFEAIWEKQAQYHPELTPELKKDIRDIIIFYQRPLKSQKGLVSFCEFESRQIEVNVDGKQKLRTIGCKVCPKSSPLFQEFKIWHTLHSLIVKEKKTNAERFLYQEEKETLFAELNIKETLSKLDALKLLYKNYKDLDLNYDKIEGNRTQAALFKAYQTIISMTGHGEYDFSKMMSDEVMEIVEGVFSGLGYNTDILHFDAENELFDKQPMYMLWHLLYSYEGDKSSTGNKSLIDKIFKLCGFEKEYASIIANIIFQPDYGSLSTKAIRKILPRMKEGNEYSLACEYAGYRHSQRSLTKDELDNKVYKDHLDLLPRNSLRNPVVEKILNQMINVVNFVVDAYGKPDEIRIELARELKKSSKERKEMTMAINKTTADHEKYRQILQKEFGLTNVTRNDIIRYKLYLELKSNGYKTLYSNTYIPQEKLFSKEFDIEHIIPKTKLFDDSFSNKTLESRRVNIEKSNLTAYDYVLGVYDEKGINDYEIRIENLYKSGIISKAKRDKLMMKEVDIPSGFIERDLRDSQYIAKKAREILEELVRFVVPTTGTITDRLREDWQLIDVMQELNWEKYDKLGLTEIVKDKDGRQIRRIKDWTKRNDHRHHAMDALTVAFTKRSYIQYLNNLNAKSDKSGSIYAIEQKELYRDKHGKLRFNPPMPLDVFRAEAKRQLENTLISIKARNKVVTQNVNITKTKKTESGYRKKIQLTPRGQLHNETFYGAIKRYVTKLESVGSGFNVEQIALVANKRYREALLTRLAACGNDPKKAFTGKNSLEKNPLYLDELHTQQVPTKVKTVTLETVYTTRKDISSDLKIEKVIDRKVRSILKERLKKFGGDPKKAFSNLDANPIWLNKEKGISIKRVTITAVSKAEPLHAKRDHFGKYILDANGAKQPVDYVNTGNNHHVAIYRDEKGVLQERVVSFYEATASASVGLPVVDKEYRKSEGWTFLFSMKQNEYFVFPNEKNGFNPNEIDLMDPDNYALISPNLFRVQKIASKDYVFRHHLETTVEDRKELQNITWKRFQSLTNLDKLVKVRVNHIGQIVSVGEY

SEQ ID NO: 7747 - protein, 1385 aa, unidentified
  REGION 1..1385: note = Description of Unknown:uncultivated organism sequence
MGTTSIGWALVNEGENYNEKSSIVKLGVRVNPLSSDEKNEFETGKALTTNAERTNKHGMRINLQRYKQRRANLVRCLKENGIIDDEALLFEHGNSSTFQTYRARAKAVDEEISLADFSRVLLMINKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNVSLRNITFYRQDYIDEFNAIWQCQSKYHKELTPALKDEIEKHIIFYQRDLKSCKSLVNHCEFEQSEKEIAVDGKKRKITIGLRACPKSSPLFQTFRTWQKLNDIMVSPSDGKNKSSAMNSVPGLFNDLKTWRPERFLKQEEKEKLFEELSVKGKLTKKEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGVGYSAACEEAGYKHSPRSLTKEELKAKVYAGKMDVVKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGVNKKEQLTPRGKLHNETVYGKISRYQTEMKRVGGSFTEDVVLSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDIAGRPMLDEDGKPVGNDYVNTSNNHHVAIFTDSEGNLQEHVVSFYEATAMAILGYPVVDRQYNKGLGWKFLFSMNQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7748 - protein, 1393 aa, unidentified
  REGION 1..1393: note = Description of Unknown:uncultivated organism sequence
MKRILGLDLGTTSIGWALVNEGENYNEKSSIVKLGVRVNPLSSDEKNEFETGKALTTNAERTNKHGMRINLQRYKQRRANLVRCLKENGIIDDEALLFEHGNSSTFQTYRARAKAVDEEISLADFSRVLLMINKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNVSLRNITFYRQDYIDEFNAIWQCQSKYHKELTPALKDEIEKHIIFYQRDLKSCKSLVNHCEFEQSEKEIAVDGKKRKITIGLRACPKSSPLFQTFRTWQKLNDIMVSPSDGKNKSSAMNSVPGLFNDLKTWRPERFLKQEEKEKLFEELSVKGKLTKKEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGVGYSAACEEAGYKHSPRSLTKEELKAKVYAGKMDVVKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGVNKKEQLTPRGKLHNETVYGKISRYQTEMKRVGGSFTEDVVLSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDIAGRPMLDEDGKPVGNDYVNTSNNHHVAIFTDSEGNLQEHVVSFYEATAMAILGYPVVDRQYNKGLGWKFLFSMNQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7749 - protein, 981 aa, unidentified
  REGION 1..981: note = Description of Unknown:uncultivated organism sequence
MCPKSSPYFQEFQIWQSLSNIRIIDKENTHLTKGQELSYDQKVMLLPELMIHSELKANKVIEILFGKKSNYTINMPSIKGNRTNETIFNALLEIVELTGHSIDNIVKTDANQQIETVKNIFDNLGYKTNFITFDSTIEGKDGLNQPYYKLWHLLYSYCGDNSKTGNEALIRKIEELTGLEKEEAKVLSNCTFENDYASLSTKAIRKLLPHLQSNLDYSEACEAAGYNHSKRSRTKEDIKNKTYKDELDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGSEALEQYINRVNNLFENGKISKTKRDNLLRKQEDIPSDFLNRDLRNTEYIAKKALEILEDYVPRVTPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQAKETYIDETRKRLIKPPYDIKQFRNDAKQMLDNIFVSHKAKNKVVTPNTIVTKKKRKAGKETKAEKKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKFPIIDKDFNKELGWVFQFTMKPNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 7750 - protein, 1382 aa, unidentified
  REGION 1..1382: note = Description of Unknown:uncultivated organism sequence
MKRILGLDLGTASVGWAVVNEAENSEEQSSITDLGSRVVLLSADEKNNFLTGKSVSATATRTAKRGARRNLQRYKLRREWLKDALVSAGIINENTCLNDSNSKELFATYISRAKAVTEQIALEYFAKVLFMINKKRGYKSNRKTDNTESEDGQIIDGLDLAKKLKARNITPGQYLLELFKENKKNKAVFYRSDLQEEVNRIWAFQSQFYPEILDNTLLSAITNKSKKAVIGLFKGIKDVEIADVKTKERTEKALTWRSEALHKQLEIGEVAYAIAEVMGAISQSSARLALLSDNSKHLEFEGLTIGQYLLKLLRNNPNSSLKNINFYRKDYEDEFNTIWKKQASFYPQLTESLRSTIFNSIFMQRNLKSCKALLANCELEFAEKKITLPEGSCQTRTIYSKVCPKSSPYFQEFQIWQSLSNIRIIDKENTHLTKGQELSYDQKVMLLPELMIHSELKANKIIEILFGKKSNYTINMPSIKGNRTNETIFNALLEIVELTGHSIDNIVKTDANQQIEAVKNIFESLGYKTNFITFDSTIEGKDGLNQPYYKLWHLLYSYCGDNSKTGNEALIRKIEDLTGLKKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANHLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGSEALEQYINRVNNLFENGKISKTKRDNLLRKQEDIPSDFLNRDLRNTEYIAKKALEILEDYVPRVTPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQAKETYIDETRKRLIKPPYDIKQFRNDAKQMLDNIFVSHKAKNKVVTPNTIVTKKKRKAGKETRAEEKRTFLTPRGPLSNETVYRKICNYETKEITINSKLTYEIALTIAKKKEREAVLDRLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKFPIIDKDFNKELGWVFQFTMKPNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 7751 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSAGIINENTCLNDSNSKELFATYVSRAKAVTEQIALEDFAKVLFMINKKRGYKSNRKTDNTESEEGQIIDGLDLAKKLKARNITPGQYLLELFKENKKNKAVFYRSDLQEELNRIWAFQSQFYPEILDNTLLSAITNKSKKAVIGLFKGIKNIEIADVKTKERTEKALTWRSEALHKQLETGEVAYAIAEVMGAISQSSARLALLSDNSKHLEFEGLTIGQYLLKLLRNNPNSSLKNINFYRKDYEDEFNSIWNKQASFYPQLTESLRSTIFNSIFMQRNLKSCKALLANCELEFAEKKITLPDGSCQTRTIYSKVCPKSSPYFQEFQIWQSLSNIRIIDKENAHLTKGQELSYDQKVMLLSELMIHSELKANKVIEILFGKKSNYTINMPSIKGNRTNETIFNALLEIVELTGHSIDNIVKTDANQQIEAVKNIFESLGYKTNFITFDSTIEGKDGLNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGAEALEQYINRVNNLFENGKISKTKRDNLLRKQEDIPSDFLNRDLRNTEYIAKKALEILEDYVPRITPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQVKETYIDETRKRLIKPPYDIKQFRNDAKQMLDNIFVSHKAKNKVVTPNTIVTKKKRKAGKETKAEKKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKFPIIDKDFNKELGWVFQFTMKQNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 7752 - protein, 1400 aa, unidentified
  REGION 1..1400: note = Description of Unknown:uncultivated organism sequence
MKRILGLDLGTTSIGWALVNEAESENEISGIVKLGVRVNPLTVDEMSNFEKGKSFSINEVRRIKRGMRRNLQRYKLRREFLIKSLTRSGIITDETILSESGPSSTFETYRLRAKAACERIELEEFARVLLMINKKRGYKSNRKIKDADSQGSTMINSIDVARKLYDEGLTPGELCKDLLKDGQKRLPDFYKSDLHDEFERIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVDGKEITIGAKVAPCSHPIFQEFKIWQVLNNLEVSLVEPVYAEAIYSNVYECFDNSFKSDESRKLEQEEKEVLARELFYKGDLSKSDVLKILFKKTKGLDLNFDRVSGNKTTHAIFSAFAEYFNGKKENTIDFKNSANEIEKHFKSAFDKYKINTDLLKIDLSKSNKEIEKEPLFRLWHLLYSYEGDNSVSGVEKLIEKLKELCNIDNDCATILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKKSTKEREDLNSAILKGNKENEAVREVLRKEFNISNPSKNDVIRYKLYQELKVNGYKTLYSNKKIDLGILFSNEIDIEHIIPQARLLDDSFSNKTLEFRDVNIEKGNRTAYDYVASKYGPEELEAYKKRCEAVCIEGKKAKLRKLMMTEADIPDGFIERDLRETQYISKKALEMLNEVFKTVTATTGSITDELRNDWQLVDLMKELNLPKYEALGEVSEIEDSKGHKKKVINDWTKRNDHRHHAVDALTVAFTKSALIQYYNYKNAAWMEGHKGHAVISAIKAKYFEGGKAKSPIPLTTFRAVVKRALESLLVSIKSKTKVVTKNKNRINRNNGPLEQNTLTPRGELHEETVRGCIKVPVWENEKIGEDFDAQKISRVADVRYRIALSNRLKEFNNDPKAAFSGKNSLTKKPINCGDGETVPQKVLVKHFENVYTVRKPVDENLNIEKVVDSRIRQLLKDRVAMFKSQKEAFADLENNPIWVNKERCIALKRVTIGENLGNAVALHYKKNKDGKFILDKEGNKIPVDFVKTGNNHHAVIYRVPQKGKDGKLKYDKDGNLEYEIVDIVVPFYEAVRRKSEGLDVIDKNLNKEEGWEFLFSMKQNEYFVFPNEKTGFDPTKIELNDPKNYSAISPNLFRVQKFSKGDYMFRHHLETTVKNESKEMKDILYKRITSLKQFENMVKVRVNHIGEIVDVGEK

SEQ ID NO: 7753 - protein, 1374 aa, unidentified
  REGION 1..1374: note = Description of Unknown:uncultivated organism sequence
MKKILGLDLGTSSIGWALVNEAENKNEKSSIIRLGVRVNPLTVDEQRNFEQGKSITTNADRTLKRSMRRNLQRYKLRRDNLVECLKENGFITDMDLLCEQGNHTTFQTYRLRAKAVVEEISLEELARVLLMINKKRGYKSNRKAKSTDEGQLVDGMSIAKQLYDEGLTPGQFGLSLLQNKKKYIPDFYRSDLNDELEKIWECQRKFYPEILTDEFKKQILGKSNRQTIKIFLDQYKIYTAGYKGKDKRLQMYQWRVDSLAKQLTIEEIAFVISELNGIIYNSSGYLGAISDRSKDLFFKKLTVGQYFVNKLDENPNYSLKNQVFYRQDYLDEFETIWENQAKYHPEMTSDLKKEIRDIIIFYQRSLKSQKGLVGFCEFESRQVETVIDGKVKMKTVGSKVCPKSSPLFQEFKIWQNLNNIAVIEKKTKSSRYLNQNEREILFQELNIKDKMTKTEVLKLLYENHKDLDLNFKEIDGNKTQAVLFKAYQTIISMTGNGEYEFSKMSYMEVIKLVTQIFGGLGYKTDILTFDSSVEGKSFDKQPMYQLWHTLYSYEGDKSNTGNDSLLRKITELSGFEKEYAVIIANVMFQPDYGSLSTKAMRKILSFMKAGHEYSLACQYAGYRHSERSETIEELDKKGYKDRLDILPKNSLRNPVVEKILNQMINVVNEVVNTYGKPDEIRIELARELKKNAKEREDMVATISKATTEHEQYRQILQKEFGLGNVSRNDIIRYKLYLELKDNGYRTLYSNTYIPQEKLFSKEFDIEHIIPQAKLFDDSFSNKTLESRSMNIEKSNLTAYDYVEGKYDASGMADYKSRIENLYKNGSIRKAKYEKLLMKEADIPSDFIQRDLRDSQYIAKKAREILESMVMFVVPTIGSITGRLREDWQLVDVMQELNWDKYDKLGLTEIIEDKDGRKIRRIKDWTKRNDHRHHAMDALTIAFTKRSIIQYLNNMNARSDKSGSIYAIEQKELQRDKHGKLRFIAPILPLEQFRIEAKHQLGNVLVSIKAKNKVVTRNINKTKKKDGYNQKIQLTPRGQLHNETIYGSMQQYVTKVESIGGGFDADQIAKVANKKYREALLLRLSVFDNNPKKAFTGKNSLDKNPVYLDEMHSQKVPTKIKTVTLETIYTIRKEISPDLKVDKVIDVQVRRILENRLKEFGGDAKKAFSNLSDNPIWLNEEKGISIKRVTITGVSNATPLHDKKDITGKLLLDSNGQKQPVDYVNTGNNHHVAIYRDECGALQEKVVSFYEATTRASLNLPIVDREYKCSEGWTFLFSMKQNEYFVFPNEKTGFNPAEIDLLDPDNYALISPNLFRVQKLATKYYVFRHHLETMVEDRKELQEITWKRLSSLNNIDKLFKVRVNHIGQIVYTGEY

SEQ ID NO: 7754 - protein, 1389 aa, unidentified
  REGION 1..1389: note = Description of Unknown:uncultivated organism sequence
MKKILGLDLGTSSIGWAIVNEKENEGEQSSIIKLGVRVNPLTVDEQRNFEAGKPITTNADRTLKRSMRRNLQRYKLRRESLLEILKSNHFITEETMLAENGNRTTFETYRLRAKAAVEEISLEELARVLLMINKKRGYKSSRKVNADDEGKIIDGMDVARKLYDENITPGQYVLDTMRRGKCYIPDFYRSDLIAEFDRIWNFQKQFYPEILTDELREELKNKNKKQTWAICAKSFSLVGIKRETKGNELKKENYQWRVESISKQTDLERLTIILQEINGQISSSSGYLGEISDRSKELYFKRQTIGQYLMERLDTNPNYSLKNKVFYRQDYLDEFEKIWETQAKFHAELTDKLKREIRDVVIFYQRPLKSQKGLISFCEFENRQIEVTVDGKKKLKTIGMRVCPKSSPLFQEFKIWQILNNIQVSGKVVPVQDTDLFGTTSRMEQGKRFLYQDEKETLFYELNIKEKMSKNEVLKLLFKNHKELDLNYKDIEGNRTMAALIKACQTIIDMSGHGEYDFSKMQAKDVMHIIETVFRGLGFNTDILHFDASVEGKAFDKQPAYMLWHLLYSFAGDNSKSGNEKLINKISELYGFDKDYASIIAGINLQQDYGSLSSKAMRKILPHMKDGLEYSVACGYAGYRHSRESLTREELDNKVLKDRLELLPRNSLRNPVVEKILNQMINVVNSVVEEYGKPDEIRIELARELKKSASEREELTKAINKTTKEHDEYKKILQTEFGIANVSRNDIIRYKLYMELKDNGFKTLYSNTYIPQEKLFSKEFDIEHIIPQAKLFDDSFSNKTIEARAINIEKSNATAYDFVCSKYDAEEIKRYEVRIEELFRKGIISKTKRDKLMMREADIPDGFIERDLRDSQYIAKKAREILCDIAREVVTTTGSVTSRLREDWQLVDVMKELNWDKYDRLGLTEIIEDKDGRKIRRITDWTKRNDHRHHAMDALTIAFTKRSYIQYLNNMNARSDKSSSIYAIEKNELYRDNGKLKFCPPIPLDVFRAEAKRHLDNILVSIKAKNKVVTRNLNVTKTRNGKNKKMQLTPRGQLHNETIYGKIKQYATKEERVNASFTEDKIATVAYQKYRMALFERLKRYNGNPKKAFTGSNTLQKNPIFLDDMHTMTVPEKVTTVTFEDVYTIRKEISPDLKIDKVIDVHVREILKARLAEYGNDPKKAFVNLKDNPIWLNKEKGIDIKRVTIRGVSNAVALHDKHDNKGQFVLDDNGIKQPVDFVSTSNNHHVAIYRDADGNLQENVVSFYEATMRANMEMPIIDKDYKKAEGWQFLFTMKQNEYFLFPNQETGFNPNEIDLLNPDNYAEISKNLFRVQKLASKYYVFRHHLETTVDDNKNLQEVTWKRITNINKLKDVVKVRINHIGQIVAVGEY

SEQ ID NO: 7755 - protein, 1393 aa, unidentified
  REGION 1..1393: note = Description of Unknown:uncultivated organism sequence
MENVKHTSMKKILGLDLGTNSTGWALVNEAENTAEKSSITKLGVRIIKYDNFVNTETGSESKEPEKDFCGGKGISPNAGRTKGRSARRNLQRYKLRRANLIEYLKKCGLITDSAVLCENGNRTTFQTYRLRAMAVTEEISLEELSRVFLMINKKRGYKSSRKAKLPDEGQLIDGMAVAEQLYENDLTPGQFVFSILQQGKKSIPEFYRSDLQNELNRIWDHQKQFYPEILTDEFRKQIEGEGRPNTAKMFLGKYKIYTADIKGKDKRLQAYQWRSNALTSQLSIDEVAFVVSELNGAINNASSYLGAIGDRSKELRFNKLTVGQYLMKQLDKDPNYSLKNQVFYRQDYLDEFEAIWEKQAQYHPELTPELKKDIRDIIIFYQRPLKSQKGLVSFCEFESRQIEVNVDGKQKLRTIGCKVCPKSSPLFQEFKIWHTLHSLIVKEKKTNAERFLYQEEKETLFAELNIKETLSKLDALKLLYKNYKDLDLNYDKIEGNRTQAALFKAYQTIISMTGHGEYDFSKMMSDEVMEIVEGVFSGLGYNTNILHFDAENELFDKQPMYMLWHLLYSYEGDKSSTGNKSLIDKIFKLCGFEKEYASIIANIIFQPDYGSLSTKAIRKILPRMKEGNEYSLACEYAGYRHSQRSLTKDELDNKVYKDHLDLLPRNSLRNPVVEKILNQMINVVNFVVDAYGKPDEIRIELARELKKSSKERKEMTMAINKTTADHEKYRQILQKEFGLTNVTRNDIIRYKLYLELKSNGYKTLYSNTYIPQEKLFSKEFDIEHIIPKAKLFDDSFSNKTLESRRVNIEKSNLTAYDYVLGVYDEKGINDYEIRIENLYKSGIISKAKRDKLMMKEVDIPSGFIERDLRDSQYIAKKAREILEELVKFVVPTTGTITDRLREDWQLIDVMQELNWEKYDKLGLTEIVKDKDGREIRRIKDWTKRNDHRHHAMDALTVAFTKRSYIQYLNNLNARSDKSGSIYAIEQKELYRDKHGKLRFNPPMPLDVFRAEAKRQLENTLISIKARNKVLTQNVNITKTKKTESGYRKKVQLTPRGQLHNETFYGAIKWYVPKLESVGSGFNVEQIALVANKRYREALLTRLAACGNDPKKAFTGKNSLEKNPLYLDELHTQQVPTKVKTVTLETVYTTRKDISSDLKIEKVIDRKVRSILKERLKEFGGDPKKAFSNLDANPIWLNKEKGISIKRVTITAVSKAEPLHAKRDHFGKYILDANGAKQPVDYVNTGNNHHVAIYRDEKGVLQERVVSFYEATASASVGLPVVDKEYRKSEGWTFLFSMKQNEYFVFPNEKNGFNPNEIDLMDPDNYALISPNLFRVQKITSKDYVFRHHLETTVEDRKELQNITWKRFQSLTNLDKLVKVRVNHIGQIVSVGEY

SEQ ID NO: 7756 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVVSLLRKGKNNIPDFYRSDLVAEFDKIWNFQRQFYPDVLTDSLKEELKGKGDKETWAICSKPFAIEGIKRKTKGWEQKKEDYAWRAESLQHKIDLEGLAIVLQKVNGQIKNSSGYLGAISDRSKELFFNKLTVGQYQMAELDKNPNFSLKNQVFYRQDYLDEFERIWETQAKFHKELTPELKHIIRDIVIFYQRPLKSQKGLISLCELESREIEIERNGKKVKKTIGPRVCPKSSPMYQEFRIWQTINNIQVSGMVVADCQVDLFGETVGKKFGKRFLEQEEKEILFKELNFKSKLTKKEILKLLFENYKELDLNYNEVKGNTTMAALLEACSKIIEMSGHGEYDFSKMSADKVESIVFPIFNGLGFNTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLPRNSLRNPVVEKILNQMINVVNAVVDTYGRPDEIRVEMARELKKTKTQREETVKAIRKTTAENEKYKKELEEEFGLKNVSRNDIIRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYEGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVTWKRINTLSKIKDIVKVRINQVGKIEDLGEY

SEQ ID NO: 7757 - protein, 1373 aa, unidentified
  REGION 1..1373: note = Description of Unknown:uncultivated organism sequence
MKKILGLDLGTTSIGWALVNEAESSEEQSSIIKLGVRVNPLSVDEQRSFEQGKSIATNTDRTLKRSMRRNLQRYKLRRENLIDCFKENGLITDETLLCENGNQTTFQTYRLRAKAVTEEISLDELARVFLMINKKRGYKSSRKVKSVEEGQKIDGMSVAMQLYDEDITPGQLVLSLFNQGKKYVPDFYRSDLQKELDRIWMCQQQFYPEILTDEFKELLKGKSKSNTIKIFLGKYKLYTADNKGKDKRLQVYQWRVDALTKQLSIEEVALVISELNGAIDSSSGYLGAISDRSKELYFNKLTVGQFLLRELERDSNWSLKNKVFYRHDYLDEFEAIWEKQATFHPELTSELKKEIRDIIIFYQRPLKSQKGLVGFCEFESRQMAICIDGKQKMKTVGCKVCPQSSPLFQEFKIWHTLNNLRVIEKSSNLSRFLEQEEKETLFMELSVKDKLNKKDALKLLYRNYKDLDLNYEDLEGDCTQSILFKAYQKIIAMTGNGEYDFSRMPSDEIKEKVKVIFDGLGYNTDILFFDSSKEGHTFDKQPMYQLWHLLYSYEGDKSNTGNDSLIRKITELCGFEKEYANIIANITFQSDYGSLSTKAIRKILPYMKEGSCYNQACEFAGYRHSQRSLTKEELDKKEYKDHLDLLPKNSLRNPVVEKILNQMINVVNHVVDTFGKPDEIRIELARELKKSAKERKVMTENINKATIDHDKYRQILQKEFGLVNVSRNDIIRYKLYLELKDNGYKTLYSNMYIPQEKLFSKEFDIEHIIPQAKLFDDSFSNKTIESRKVNIEKSNLTAYDYVLNKYDIEGVRDYEVRIENMYKNGALRKTKYNKLLMKEADIPNDFIERDLRDSQYIAKKAREILEDLVKFVVPTVGSITDRLREDWQLVDVMQELNWDKYDKLALTEIVEDKDGRKIRRIKDWTKRNDHRHHAMDALTIAFTKRCIIQYLNNLNARSDKSSSIYGIERKELYRDKHEKLRFIPPMPLDVFRTEAKRHLESVLISIKAKNRVVTPNINRTKAQNGYNKKEQLTPRGQLHNETIYGSIKQYVTKIETVGGGFGAMQIAKVANKKYRDALLARLVAFDNDPKKAFTGKNSLEKNPIYLDELHTQRVPIKIKTVTLDTIYTIRKSISPDLKIDKVVDVKIRRLLEKRLVDYGGDARKAFSNLEDNPIWLNEEKGISIKRVTITGVNNAEPLHCKKDHNGELILDSEGKKQPVDYVNTGNNHHVAIYRDEKGELQENVVSFYEATARAILGEAIVNKAYNDSEGWSFLFSMKQNEYFVFPNENTGFDPNEIDLLDPDNYALISPNLYRVQKITSKDYVFRHHLETTVENKKELQNITWKRVTSLTNFDKIVKVRINHIGQIVFVGEY

SEQ ID NO: 7758 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNISLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFERQTAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDFVLTKYGEQGNNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRELGIAIKRVTIYGVSNATALHDKRDMHGKKMLDSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7759 - protein, 1393 aa, unidentified
  REGION 1..1393: note = Description of Unknown:uncultivated organism sequence
MENVKHTSMKKILGLDLGTNSTGWALVNEAENTAEKSSITKLGVRIIKYDNFVNTETGSESKEPEKDFCGGKGISPNAGRTKGRSARRNLQRYKLRRANLIEYLKKCGLITDSAVLCENGNRTTFQTYRLRAMAVTEEISLEELSRVFLMINKKRGYKSSRKAKLPDEGQLIDGMAVAEQLYENDLTPGQFVFSILQQGKKSIPEFYRSDLQNELNRIWDHQKQFYPEILTDEFRKQIEGEGRPNTAKMFLGKYKIYTADIKGKDKRLQAYQWRSNALTSQLSIDEVAFVVSELNGAINNASSYLGAIGDRSKELRFNKLTVGQYLMKQLDKDPNYSLKNQVFYRQDYLDEFEAIWEKQAQYHPELTPELKKDIRDIIIFYQRPLKSQKGLVSFCEFESRQIEVNVDGKQKLRTIGCKVCPKSSPLFQEFKIWHTLHSLIVKEKKTNAERFLYQEEKETLFAELNIKETLSKLDALKLLYKNYKDLDLNYDKIEGNRTQAALFKAYQTIISMTGHGEYDFSKMMSDEVMEIVEGVFSGLGYNTNILHFDAENELFDKQPMYMLWHLLYSYEGDKSSTGNKSLIDKIFKLCGFEKEYASIIANIIFQPDYGSLSTKAIRKILPRMKEGNEYSLACEYAGYRHSQRSLTKDELDNKVYKDHLDLLPRNSLRNPVVEKILNQMINVVNFVVDAYGKPDEIRIELARELKKSSKERKEMTMAINKTTADHEKYRQILQKEFGLTNVTRNDIIRYKLYLELKSNGYKTLYSNTYIPQEKLFSKEFDIEHIIPKAKLFDDSFSNKTLESRRVNIEKSNLTAYDYVLGVYDEKGINDYEIRIENLYKSGIISKAKRDKLMMKEVDIPSGFIERDLRDSQYIAKKAREILEELVKFVVPTTGTITDRLREDWQLIDVMQELNWEKYDKLGLTEIVKDKDGREIRRIKDWTKRNDHRHHAMDALTVAFTKRSYIQYLNNLNARSDKSGSIYAIEQKELYRDKHGKLRFNPPMPLDVFRAEAKRQLENTLISIKARNKVLTQNVNITKTKKTESGYRKKVQLTPRGQLHNETFYGAIKWYVPKLESVGSGFNVEQIALVANKRYREALLTRLAACGNDPKKAFTGKNSLEKNPLYLDELHTQQVRTKVKTVTLETVYTTRKDISSDLKIEKVIDRKVRSILKERLKEFGGDPKKAFSNLDANPIWLNKEKGISIKRVTITAVSKAEPLHAKRDHFGKYILDANGAKQPVDYVNTGNNHHVAIYRDEKGVLQERVVSFYEATASASVGLPVVDKEYRKSEGWTFLFSMKQNEYFVFPNEKNGFNPNEIDLMDPDNYALISPNLFRVQKITSKDYVFRHHLETTVEDRKELQNITWKRFQSLTNLDKLVKVRVNHIGQIVSVGEY

SEQ ID NO: 7760 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCKGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNISLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFECQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLAKYGEHGDNGSIKYRERIDTLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRELGIAIKRVTIYGVSNATALHDKRDMHGKKMLDSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNVDTPKELSGITYARLSLKGIVGIVKVRVNHLGEIVAVGEY

SEQ ID NO: 7761 - protein, 555 aa, unidentified
  REGION 1..555: note = Description of Unknown:uncultivated organism sequence
MLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTYKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7762 - protein, 638 aa, unidentified
  REGION 1..638: note = Description of Unknown:uncultivated organism sequence
MYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQEREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYII

SEQ ID NO: 7763 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLVHGMRLNLSRYKQRRKELIKNLIRFKFISPDTVLCENGSNTTFETLRLRAKAATEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGCPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQKREITVDGKKKIIEFGPKVCPKSSPIFQEFKIWQTINNLKISNIYGEELSLSADERQILFEELSIRKKLTCAEILKLLHKDSKCSLNYKEIQGNTTISAIFDAFKEIILQSGHDNNNLNKASFKDTMLIIEPIFKMLGISTEILSLDSPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVGLTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7764 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVVSLLRKGKNNIPDFYRSDLVAEFDKIWNFQRQFYPDVLTDSLKEELKGKGDKETWAICSKPFAIEGIKRNTKGWEQKKEDYAWRAESLQHKIDLERLAIVLQKVNGQIKNSSGYLGAISDRSKELFFNKLTVGQYQMAELDKNPNFSLKNQVFYRQDYLDEFERIWETQAKFHKELTPELKHIIRDIVIFYQRPLKSQKGLISLCELESREIEIERNGKKVKKTIGPRVCPKSSPMYQEFRIWQTINNIQVSGMVVADGQVDLFGETVGKKFGKRFLEQDEKEILFKELNFKSKLTKREILKLLFENYKDLDLNYNEVKGNTTMAALLASCSKIIEISGHGEYDFSKMSADEITGIVFPIFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLPRNSLRNPVVEKILNQMINVVNAVVDTYGSPDEIRVEMARELKKTKTQREETVKAIRKTTAENEKYKKELEEEFGLKNVSRNDIIRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYGGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKDIDLLNPKNYALISPNLFRVQKLSSKDYVFRHHLETKVEYNKELFGVIWKRIKSLGKIKDIVKVRINQIGKIEDLGEY

SEQ ID NO: 7765 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNKFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRFYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDAVPVKVKTVVPKPVFTQRIAVDIKLDKTKIAQILDAKIRRILTNRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETKVDDNNALKGTTWIRIRSLPALENIIKVRVNNIGQIVAVGEY

SEQ ID NO: 7766 - protein, 1393 aa, unidentified
  REGION 1..1393: note = Description of Unknown:uncultivated organism sequence
MENVKHTSMKKILGLDLGTNSTGWALVNEAENTAEKSSITKLGVRIIKYDNFVNTETGSESKEPEKDFCGGKGISPNAGRTKGRSARRNLQRYKLRRANLIEYLKKCGLITDSAVLCENGNRTTFQTYRLRAMAVTEEISLEELSRVFLMINKKRGYKSSRKAKLPDEGQLIDGMAVAEQLYENDLTPGQFVFSILQQGKKSIPEFYRSDLQNELNRIWDHQKQFYPEILTDEFRKQIEGEGRPNTAKMFLGKYKIYTADIKGKDKRLQAYQWRSNALTSQLSIDEVAFVVSELNGAINNASSYLGAIGDRSKELRFNKLTVGQYLMKQLDKDPNYSLKNQVFYRQDYLDEFEAIWEKQAQYHPELTPELKKDIRDIIIFYQRPLKSQKGLVSFCEFESRQIEVNVDGKQKLRTIGCKVCPKSSPLFQEFKIWHTLHSLIVKEKKTNAERFLYQEEKETLFAELNIKETLSKLDALKLLYKNYKDLDLNYDKIEGNRTQAALFKAYQTIISMTGRGEYDFSKMMSDEVMEIVEGVFSGLGYNTNILHFDAENELFDKQPMYMLWHLLYSYEGDKSSTGNKSLIDKIFKLCGFEKEYASIIANIIFQPDYGSLSTKAIRKILPRMKEGNEYSLACEYAGYRHSQRSLTKDELDNKVYKDHLDLLPRNSLRNPVVEKILNQMINVVNFVVDAYGKPDEIRIELARELKKSSKERKEMTMAINKTTADHEKYRQILQKEFGLTNVTRNDIIRYKLYLELKSNGYKTLYSNTYIPQEKLFSKEFDIEHIIPKAKLFDDSFSNKTLESRRVNIEKSNLTAYDYVLGVYDEKGINDYEIRIENLYKSGIISKAKRDKLMMKEVDIPSGFIERDLRDSQYIAKKAREILEELVRFVVPTTGTITDRLREDWQLIDVMQELNWEKYDKLGLTEIVKDKDGREIRRIKDWTKRNDHRHHAMDALTVAFTKRSYIQYLNNLNARSDKSGSIYAIEQKELYRDKHGKLRFNPPMPLDVFRAEAKRQLENTLISIKARNKVLTQNVNITKTKKTESGYRKKVQLTPRGQLHNETFYGAIKWYVPKLESVGSGFNVEQIALVANKRYREALLTRLAACGNDPKKAFTGKNSLEKNPLYLDELHTQQVPTKVKTVTLETVYTTRKDISSDLKIEKVIDRKVRSILKERLKEFGGDPKKAFSNLDANPIWLNKEKGISIKRVTITAVSKAEPLHAKRDHFGKYILDANGAKQPVDYVNTGNNHHVAIYRDEKGVLQERVVSFYEATASASVGLPVVDKEYRKSEGWTFLFSMKQNEYFVFPNEKNGFNPNEIDLMDPDNYALISPNLFRVQKITSKDYVFRHHLETTVEDRKELQNITWKRFQSLTNLDKLVKVRVNHIGQIVSVGEY

SEQ ID NO: 7767 - protein, 1297 aa, unidentified
  REGION 1..1297: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELGLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWVVSIVTKIRILKQITTPRPRARSLAKLYL

SEQ ID NO: 7768 - protein, 1377 aa, unidentified
  REGION 1..1377: note = Description of Unknown:uncultivated organism sequence
MNHTMKRILGLDLGTNSIGWALVDEAENKEEQSSIIRLGVRVNPLTVDEQKNFEQGKSITTNAYRRLKRCMRRNLQRYKLRRKNLINCLLSNGIIQETTFLCESGNRTTFETYRLRAKAVTDEISLEEFARVLLMINKKRGYKSSRKAKSADEGQLIDGMTIAKQLYDENITPGQFVLSLLNEGKNYIPDFYRSDLQSELDRIWKYQRQFYADILTDDFKEQLKGKGKQNSSKIFLGKYQIYTADNKGKDKRLQAYRWRVEALSKQLTIEEVAFVICEINGLINNSSGYLGSISDRSKDLVFNKQTVGQALMNGLIKDPHYSLKNQVYYRQDYMDEFEAIWETQAKYHSELTPELKKEVRDIIIFYQRPLKSQKGLIGYCELENSQIEIEVDGKMKMKTIGSRVCPKSSPLFQEFKIWQILNNIKVTEKSTGACRYLEQEEKDILFFELSVKDKLSKLDVLKYLFKNYKELDLNFKEIEGNRTQSLLFKAYQDIIAMTGHKEYDFSKMSAHDVIKTVTDIFTGLGYRTDMLNFDSSIKGHDFDKQPMYLLWHLLYSYEGDKSNTGIDSLLAKIEELTGLEREYAKRLANITFQPDYGNLSAKAIRKILPLIKKGTEFSSACKNVGYNHSKRSQTREELEDKVYKDHLDILPRNSLRNPVVEKILNQMINLVNSVIDTYGKPDEIRIELARELKKSAKEREEMMNSINKARAEHEKYREILQKEFGISNVSRNDIIRYKLYLELKDNGYKTLYSNTYIPQERLFSKEFDIEHIIPQARLFNDSFSNKTLESRSVNIEKSNQTAYDYVLNKYGVKDIEDYKIRIENLYKTNAISKTKRNNLLMRSTDIPDDFIKRDLRTTQYIARKACEILEDVVKCVLPTTGLITDRLREDWQLVDVMQELNWDKYDKLGLTEVLEDKDGRKLYRIKEWTKRNDHRHHAMDALTIAFTKESFIQYLNNLNAKSDKSSSIYGIEQKELYRDKHGKLRFVPPMPLDIFRMEAKYHLENTLVSIKAKNKVVTQNTNKIKLKNGFKKKVQLTPRGQLHNETIYGSMKRYVTKEEKIGAGFTVERIAKVANQKYREALLKRLFEWNGDPKRAFTGKNSLEKNPIYLDELRTWRVPVKVKTVEQETIYTVRKAIGPDLKIDKIVDGRIRQILQERLKEFGGDAKKAFGNLDENPVWLNKEKGIVIKRVTITGASSVTPLHDKKDHRGQYMLESTGRKQPVDFVNTGNNHHVAIYRDGKGNLQEKVVSFYEATSRIALGLPIIDKAYKSSEGWNFLFSMKQNEYFVFPNEEIGFNPSEIDLTDAENYALISPNLFRVQKLTSKDYVFRHHLETIVDDKKELHGITWKRLSSLNNLDKIVKVRVNHIGQIVFVGEY

SEQ ID NO: 7769 - protein, 1395 aa, unidentified
  REGION 1..1395: note = Description of Unknown:uncultivated organism sequence
MKKILGLDLGTNSIGWALVKERENENEQSSIIRLGVREIYLTTDEQSNFEKGKSITTNADRTQKRSMRRNLQRYKIRRDSLINVLKDHGFITADTLLNENGNRTTFETYRLRARAVTEEISLEEFARVLLMINKKRGYKSSRKVKSNDESGQLIDGMEVAKKLYDDNLTPGQYVALLLHNGKNSISDFYRSDLVDEFNKIWNFQRLFYPNVLTDNLKEELKGKGDKETWAICSKPFDIVGLKRKTKGWEQKKEDYVWRAESLHHKIDLERLAIVLQKVNGQIKNSSGYLGAISDRSKELFFNKLTVGQYQMSELDKNPNFSLKNQVFYRQDYLDEFECIWETQAKFHKELTPELKHIIRDIVIFYQRPLKSQKGLISLCELESREIEIEKNGKKFKKTIGPRVCPKSSPMYQEFRIWQTINNLQVSGMIVADNRFDLFGETVGMKSGKRFLEQEEKEILFKELNFKSKLAKKEILRLLFKNYKELDLNYNEVKGNTTMAALLEAYSKIIEMSGHGEYDFSKMTADEIKDIVFPIFNGLGFNTDILSFDSSVEGKALEKQPSYMFWHLLYSYEGDKSKTGNESLINKISECYGFDKEYAAVIAGIRLEPDYGNLSVKAMRKILPYMKDGLGYSDACQYAGYRHSKRSLTKEEIDSRPLKNKMDLLPRNSLRNPIVEKILNQMINVVNAVVDVYGRPDEIRVEMARELKKTKAQREETVKTIRKVTVENEKYKKELEEEFGLKNVSRNDIIRYRLYLELKDNGFKTLYSNTYIPREKLFSKEFDIEHIIPQAKLFDDSLSNKTLEARNVNIEKADSTAYDYVKAKYGDEGLKKYNEKVKQLYEKKIIGKTKFKRLLTTEKDIPDGFINRDLSNTQYIARKACEILEEVARRVVATTGSVTSRLREDWQLVDIMKELNWDKYDRLGLTEIVEDRDGRRIKHIKDWTKRNDQRHHAMDALTIAFTKPAFIQYLNNLNARSDKGGSIYTIERKELYRDNKGKLRFYPPMPLDEFRAEAKCHLENILVSIKAKNKVVTRNVNITRAEKAEKGKHERIQLTPRGKLHNETIYGSIKRYDGNKEKVNASFDVSKIMTVADKRYREALLRRLEQFEGDSRKAFTGKNSLEKNPLFVDELHTKKVPDIVKTVKFGTIYTQRKEISDELKIDKVIDNKVRKILEERLAEFNGDAKKAFSNLDENPIWLNKEKGISIKRVTINSGLKDLIALHDKCDNNGRLILDKGGRKQPIDFVKTDGNHHVAIFCDSEGNIQEHLVSFYEAVARAIQHLPVIDRTFNRDKGWQFMFTMKKNEYFVFPNKKTGFDPNEIDLLNPKNYAAISPNLYRTQTLSSRDYFFRHHLETTVDNKKELQGITWKRIRSLDNLRNIVKVRINHLGHIVDFGEY

SEQ ID NO: 7770 - protein, 1283 aa, unidentified
  REGION 1..1283: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFS

SEQ ID NO: 7771 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISIDELARVLIMINKKRGYKSSRKVNSGEEGSLIDGMAVARKLYDEHLTPGQYVYQLLCRGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEIIKLLFGSKKGLSLNFRKVEGNRTMALFVRACQTVLAINGYNDYDFSKMSYDKAMPIITQVFEALGFNTSFLTFDPTLDGKDFECQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLAKYGEHGDNGSIKYRERIDTLYKEGVISKTKHDKLLMTTAEIPNGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLAEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDFVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLGLKGIVGIVKVRVNHLGEIVAVGEY

SEQ ID NO: 7772 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVLSLLRKGKNNIPDFYRSDLVAEFDKIWNFQRQFYPDVLTDSLKEELKGKGDKETWAICSKPFAIEGIKRNIKGWEQKKEDYAWRAESLQHKIDLERLAIVLQKVNGQIKNSSGYLGAISDRSKELFFNKLTVGQYQMAELDKNPNFSLKNQVFYRQDYLDEFERIWETQAKFHKELTPELKHIIRDIVIFYQRPLKSQKGLISLCELESREIEIERDGKKTKKTIGPRVCPKSSPMYQEFRIWQAINNLQVSGMVVADNQVDLFGKTIGKKFGKRFLEQEEKEILFKELNFKSKLTKKEILKLLFENYKELDLNYNEVKGNTTMAALLEVCSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACQYAGYRYSKRSLTKEEIEARPLKDKIDLLPRNSLRNPVVEKILNQMINVVNAVVDTYGSPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKDKLRFYPPMPLDEFRTEAKRHLENILVSIKAKNKVVTRNVNITKAKKAEKGKRKRIQLTPRGQLYNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYEGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVTWKRINTLSKIKDIVKVRINQVGKIEDLGEY

SEQ ID NO: 7773 - protein, 793 aa, unidentified
  REGION 1..793: note = Description of Unknown:uncultivated organism sequence
MSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHYLETTVDTNNALNGTTWKHVQSLKALENIIKVRVNNIGQIVAVGEY

SEQ ID NO: 7774 - protein, 568 aa, unidentified
  REGION 1..568: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKATTEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQEREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRY

SEQ ID NO: 7775 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLAHGMRLNLSRYKQRRKELIKNLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRTQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7776 - protein, 1398 aa, unidentified
  REGION 1..1398: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFAAITFMPDYGNLSAKAMRRILPYMMDGNEYSVACEYAGYRHSRRSLTKEELDKKPLVDTLPLLPRNSLRNPVVEKILNQMINVVNEVSAQYGKPDEIHIEMARELKKSAKEREQMTADITRATAQQEEYRRILQDEFGMPHVSRNDIIRYRLWLELKDNGYKTLYSQTYIPREKLFSKEFDVEHIIPQARLFDDSFSNKTLEARQANLEKSDATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKAGSIYAIEQTCLYRDAHSKLRFMPPMPLDVFRAEARRQLQDILVSTKAKNKVVTRNINSIKRRGEKKQTVQLTPRCQLHNETVYGSVRCCVVKEEKISSSFTEEKIATVASPRYREALLKRLGENGGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 7777 - protein, 1372 aa, unidentified
  REGION 1..1372: note = Description of Unknown:uncultivated organism sequence
MKKILGLDLGTNSIGWALVNEAENQEETSSIVKLGVRVNPLTVDEQRNFEQGKSITTNADRSLKGCMRKNLQRYKLRRQNLIEVLCNNNFISNETVLSEEGNYTTFQTYRLRSKAATEKITLEEFSRVLLMINKKRGYKSNRKAQSNDEGELIDGMSIAIQLYENAQTPGQFSLSLLRQSKKHLPAFYRSDLQSELSKIWNFQRQFYPDILTDEFKEQIKNKGKLNTSKIFLGKYKIYTADNKGKDKQLQAYQWRSEALSKQLSLEEVASVICDVNGAIYNSSGYLGNISDRSKELYFNKQTVGQYLMAELDKNPNYSLKNKVFYRQDYLDEFEKLWETQALYHPELTPELKQEIRDIIIFYQRPLKSKKGLIDFCELESKQIEVTCDGKKKLKTVGLRVCPKSSPLFQEFKIWQVLNNIQVSEGKNHKRFLEQEEKERLFAELNWKEKLSKAEVSQLLYVKPTGIDLNFKEIEGNRTQAALLNIYLKIIEASGHDIANLSKASMPEVIKIVKTIFNGLGYNTDILSFDSSLEGKEFEEQPMYRLWHLLYSFEGDESKTGNEKLVNKLTELYGFEKEYAILLINITFQSDYGSLSTKAMRKILPFMKSGHEYSLACEYAGYRHSKRSLTKEELDKKVYIDKLSLLPRNSLRNPVVEKILNQMINVVNSIVDTYGKPDEIRIELARELKKSAKEREDMTNNIRKTTNEHEEYKVILQKEFGLANVSRNDIIRYKLYLELKDNGYKTLYSNTYIPREDLFTKKFDIEHIIPQAKLFDDSFSNKTLESRSINIAKSNATAYDFVKNKYSEQELSDYVERIHILFKNGSISKAKHDKLLMEEANIPSGFIERDLRDSQYIAKKAREILEDLVKFVVPTTGSITNRLREDWQLVNVMQELNWEKYNKLCLTEIYEDKDGRKIRRIKDWTKRNDHRHHAMDALTIAFTKQSFIQYLNNMNARSDKSGSIYGIEQKELYRDEHNKLRFNPPMPLNEFRAEAKRQLENILVSIKAKNKVVTQNTNKSKKKNGLNTKVQLTPRGQLHNETIYGSIKQYVTKMEKVGSGFDAEKVLQVANKEYRETLLHRLTLFGNDPKKAFTGKNSLDKNPIYLDELQTRQVPTTIKTVSLETIYTIRKEISPDLKIEKVIDVQIRRILEARLKEYQGNAKQAFSNLEENPIWLNKEKNIAIKRVTISGISNATSLHDKRDHNGNLILDEKGRKQPVDFVSTSNNHHVAIYRDANDNLQENIISFFEATTRASLGLPIVDKEYKKSEGWTFLFSMKQNEYFVFPNKETGFDPSEIDLTDPDNYARISPNLFRVQKIATKDYTFRHHLETTVNTTKELQGLTWLRISSLNNLDKLAKVRINHIGQIISVGEY

SEQ ID NO: 7778 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSAGIINENTCLNDSNSKELFATYASRAKAVTEQIALEDFAKVLFMINKKRGYKSNRKTDNTESEDGQIIDGLDLAKKLKARNITPGQYLLELFKENKKNKAVFYRSDLQEELNRIWAFQSQFYPEILDNTLLSAITNKSKKAVIGLFKGIKNIEIADVKTKERTEKALTWRSEALHKQLETGEVAYAIAEVMGAISQSSARLALLSDNSKHLEFEGLTIGQYLLKLLRNNPNSSLKNINFYRKDYEDEFNSIWNKQASFYPQLTESLRSTIFNSIFMQRNLKSCKALLANCELEFAEKKITLPDGSCQTRTIYSKVCPKSSPYFQEFQIWQSLSNIRIIDKENAHLTKGQELSYDQKVMLLSELMIHSELKANKVIEILFGKKSNYTINMPSIKGNRTNETIFNALLEIVELTGHSIDNIVKTDANQQIEAVKNIFESLGYKTNFITFDSTIEGKDGLNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGAEALEQYINRVNNLFENGKISKTKRDNLLRKQEDIPSDFLNRDLRNTEYIAKKALEILEDYVPRITPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQVKETYIDETRKRLIKPPYDIKQFRNDAKQMLDNIFVSHKAKNKVVTPNTIVTKKKRKAGKETKAEKKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKFPIIDKDFNKELGWVFQFTMKQNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 7779 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSAGIINENTCLNDSNSKELFATYVSRAKAVTEQIALEDFAKVLFMINKKRGYKSNRKTDNTESEDGQIIDGLDLAKKLKARNITPGQYLLELFKENKKNKAVFYRSDLQEEVNRIWAFQSQFYPEILDNTLLSAITNKSKKAVIGLFKGIKNVEIADVKTKERTEKALTWRSEALHKQLEIGEVAYAIAEVMGAISQSSARLALLSDNSKHLEFEGLTIGQYLLKLLRNNPNSSLKNINFYRKDYEDEFNTIWKKQASFYPQLTESLRSTVFNSIFMQRNLKSCKALLANCELEFAEKKITLPDGSCQTRTIYSKVCPKSSPYFQEFQIWQSLSNIRIIDKENTHLTKGQELSYDQKVMLLPELMIHSELKANKIIEILFGKKSNYTINMPSIKGNRTNETIFNALLEIVELTGHSIDNIVKTDANQQIEAVKSIFESLGYKTDFITFDSIIEGKDGLNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREFKKNKIQRKKLDNQLKENTAKLEHIKDILRKDFKLSHISHNDILRYRLYEELSLNGYKTLYSNTYIDRQQILDPTVTIEHIVPKALAFDDSFSNKTLEIQSVNGEKSNQTAFDFISKKYGSEALEQYINRVNNLFENGKISKTKRDNLLRKQEDIPSDFLNRDLRNTEYIAKKALEILEDYVPRVTPTIGKITKRLREEWQLVNIMKELNWKKYNSLGLTFFDYTRNGEKIGIIPNWTKRNDHRHHAIDALTIAFTKPSIIQYLNNLKAQNDKGSSIYAIQAKETYIDETRKRLIKPPYDIKQFRNDAKQMLDNIFVSHKAKNKVVTPNTIVTKKKRKTGKETKAEEKRTFLTPRGPLSNETVYRKICNYETKEITINSKLTYEIALTIAKKKEREAVLERLAQHNNNPTKAFKNYNKNPIMLQTSVGEKSLMSVKIVNYKELFVKRSEINEELDIKRVLDAKVRARLTDRLKEYNNDPKTAFANLEENPIWLNEEKGIALKHVTTIERVVGLPIRPKRNINGEIMKDEQGQPLKSHYIETDGNHHAAIYEDEEGKWHEKVVSFNEAASRAIQKLPIIDKDFNKELGWVFQFTMKQNEMFVFPDKESGFDPLAIDLKDPANKSLISKHLYRVRSISSNDYRFCHHLETTVATPKELKDITWKRIRSLSSLQGIIKVRVNHIGQIIDIGEY

SEQ ID NO: 7780 - protein, 1381 aa, unidentified
  REGION 1..1381: note = Description of Unknown:uncultivated organism sequence
MKKILGLDLGTNSIGWALVYEAETKEEMSSIIKLGVRVNPLTVDEKQNFEKGKSITTNAERTSKRSMRRNLQRYKLRRENLIDVLKSNNFISDETILSENGNRTTFETYRLRAKAANEEISLEELGRVLLMINKKRGYKSSRKAKNQEEGQLIDGMDIAKKLYYDKITPGQLILQLLKAGGKNIPDFYRSDLQAEFDKIWEFQKSFYPEILVDDFKQQIGGKGKMNTSKIFLARFGIYTADNKGKDKKLQAGQWRVDSLSIQLPKSELAFVISDVNGSISNSSGYLGSISDRSKELFFNKQTVGQNLMSQLDEDPNTKLKNQVFYRQDYLDEFNIIWEKQAEFHSELTTELKKEVRDIVIFYQRHLKSQKGLVSFCEFESRPIELEIEGKKKVKIVGSKVCPRSSPIFQEFKIWQILNNIEVTDKASRIKRLLEQDEKESLFAELNLRTKMAKTDVLKHLFKNYRDLDLNYKDVEGNKTQAALFEAYAKIISLSGHNGFDFSELTSAQILERVHLIFEGLSYSTDILYFNAELEGKDFENQPIYQLWHLIYSFEGDDSKTGDEKLRNKLTSLYGFENEYAALLANLNFQSDYSNLSTKAIRKILPYLKAGHEYSIACEYAGYKHSKSSLTKEEIENKILKDKLDILPKNSLRNPVVEKILNQMINVVNSVVDSYGKPDEIRIELARELKKSAKEREELTTYIGQSTIEHDKYRKILQTEFGLTNVSRNDLIRYKLYLELEPKGFKTLYSDTYIPPSKLFSKEFDIEHIIPQSRLFDDSFSNKTLESRDVNIEKGNNTAYDYLHSKLGEGGLNEYLIRVDELYKFGKISKSKYNKLRMKGTDIPDDFIARDLRDTQYIARKAKSILEDLARRVTSTSGSITNRLREDWQLIDVMQELNWEKYNLMGMTEIIENREGQKIRRIKEWTKRNDHRHHAMDALTIAFTKTSFIQYLNNLNARSDKAGSIYGIEQKELYRDDKGKLKFKPPIPLEKFRAEAKKHLENTLISIKAKNKVSTSNINVTDKKGGNNKKKQLTPRGQLHLESVYGSISQYVSREEKVGSAFNEEKIATVSKWKYRDALLNRLIEYGKDPKEAFTGINSLDKNPIYLDALQTLKVPEKVKVVWMETVYTIRKEITPVLKLDKVIDVGIRNILQARLNDFGGNNKQAFSNLDENPIWLNEGKGISIKRVTITGVSNAIALHDKKDKEGNLILTSDGKNQGADFVNTGNNHHVAIYKDAKDKLQDNVVSFFEATSRVNLGLPIIDRDYYNDEGWEFKFSLKQNEYFVFPNEKTGFNPKDIDLLDADNYYLISPNLYRVQKFSKVIYGNAAVRDYVFRHHLESSIQDNKNMKDITYKSIKSLPIFDSIVKVRINHLGLIISTGEY

SEQ ID NO: 7781 - protein, 1007 aa, unidentified
  REGION 1..1007: note = Description of Unknown:uncultivated organism sequence
MVVDGKKKTITIGLRVCPKSSPLFQCFKIWQTINNLQVTGEVVPKAQLDLFGDTTECEHGTRTLTEEEKSDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFERQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTVSSPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERRIAIKRVTIYGVSNATALHDKRDMHGKKMLDSNGISIPIDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNVDTPKELSGITYARLSLKGIVGIVKVRVNHLGEIVAVGEY

SEQ ID NO: 7782 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTKKRSARRNLQRFKLRRENLLTLLKEHGFITDETVLCEQGNRTTFETRQLRARAVTEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPLPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKEILEARLKEFGGDTKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEVDLLDSKNYAVISDNLFRVQKLATKDYFFRHHLETSVENNKSLCDITWKRITSLNKLQGIVKVRVNNIGQIVAVGEY

SEQ ID NO: 7783 - protein, 1373 aa, unidentified
  REGION 1..1373: note = Description of Unknown:uncultivated organism sequence
MVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFGINGMKRNGTAAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVEGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDKFGMPHVSRNDIIRYRLWLELKDNGYKTLYSQTYIPREKLFSKEFDVEHIIPQARLFDDSFSNKTLEARQANLEKSDATAFDYVQSKYGEKGAKEYKERIDYLYADDVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGENGGDAKKAFTGRNSLEKNPLYLNDDHTLNVPAKVKTVTYETIFTQRKPIDKDLKVDKVIDEHVKEILEARLKEFGGDAKKAFSNLDENPIWLNRERGIQIKRVTIRGVSNAVALHDKHDVQGKPICDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7784 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFIADDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYADIFTDVLREALRSKNEKQTWAICAEPLGLKGIKRNGSTADQRVENYRWRTEAISKQMPLEQVAVVLQKINSQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKAQLDLFGDTTECEHGTRTLTEEEKSDLYRELSIKESLSETEILKLLFGSNKGLSLNFRKVEGNRTMALFVRACQTVLAINGYNDYDFSKMSYDKAMPIITQVFEALGFNTSFLTFDPTLDGKDFERQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPDGFISRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVDKVVDQRVRKLLQERLAEYGGDAKKAFANLDENPIWLNRERGIAIKRVTIYGVSNATALHDKRDMHGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7785 - protein, 1392 aa, unidentified
  REGION 1..1392: note = Description of Unknown:uncultivated organism sequence
MKKILGLDLGTTSIGWALVNEKENDNEQSSIIKLGVRVNPLSVDKNEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDKFGMPHVSRNDIIRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTQHSFIQYLNNLNARSNKSGSIYAIEQTCLYRDAHGKLRFMPPMPLDVFRAEARRQLQDILVSTKAKNKVVTRNINSIKHRGEKKQTVQLTPRCQLHNETVYGSVRCCVVKEEKISSSFTEEKIATVASPRYREALLKRLGENGGNAKKAFTGRNSLEKNPLYLNDDHTLSVPAKVKTVTYETIFTQRKPIDKDLKVDKVIDEHVKEILEARLKEFGGDAKKAFSNLEENPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7786 - protein, 1398 aa, unidentified
  REGION 1..1398: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEYGFITDETVLCEQGNRTTFETRQLRARAVSEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKQKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPACQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKNWTKRNDHRHHAMDALTIAFTKHSFIQYLNNLNARSNKSGSIYAIEQTCLYRDAHGKLRFMPPMPLDVFRAEARRQLQDILVSTKAKNKVVTRNVNSIKRRGEKKQTVQLTPRCQLHNETVYGSMRCCVVKEEKISSSFTEEKIATVASPRYREALLKRLGEYGGNAKKAFTGRNSLEKNPLYLNDDHTLSVPAKVKTVTYETIFTQRKPIDKDLKVDKVIDEHVKKILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISANLFRVQTMSKLQYGNSFVRDYKFRHHLETTLNDNKELRDITYKQFKSLNFADTIVKVRVNNIGQIVAVGEY

SEQ ID NO: 7787 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSDEDGKLIDGMSVARQLYEQHLTPGQYVLNLLRNGKKYLPDFYPSDLTAELKAVWHAQQAYYPELLTQELFDALKNKNEKQTWAICAQPFGIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDKFGMPHVSRNDIIRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTQHSFIQYLNNLNARSNKSGSIYAIEQTCLYRDAHGKLRFMPPMPLDVFRAEARRQLQDILVSTKAKNKVVTRNINSIKRRGEKKQTVQLTPRCQLHNETVYGSVRCCVVKEEKISSSFTEEKIATVASPRYREALLKRLGENGGNAKKAFTGRNSLEKNPLYLNDDHTLSVPAKVKTVTYETIFTQRKPIDKDLKVDKVIDEHVKEILEARLKEFGGDAKKAFSNLEENPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7788 - protein, 537 aa, unidentified
  REGION 1..537: note = Description of Unknown:uncultivated organism sequence
MTTAEIPNGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDFVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNGDTPKELSGITYARLGLKGIVGIVKVRVNHLGEIVAVGEY

SEQ ID NO: 7789 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYAGIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKAQLDLFGDTTECEHGTRTLTEEEKSDLYRELSIKESLSETEILKLLFGSKKGLSLNFRKVEGNRTMSLFVKACQTVLVINGYNDYDFSKMSYDKAMPIITQVFEALGFNTSFLTFDPTLDGKDFERQTAYQLWHLLYSYSGDNSATGNEKLIERLRNLLNMDRDSAAVFVSIPLEPDYGSLSAKAMRRILPHMMDGLEYSVACEYAGYRHSRRSLTKEDIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWLLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMNGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7790 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLVHGMRLNLSRYKQRRKELIKNLIRFKFISPDTVLCENGSNTTFETLRLRAKAATEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGCPSEKKRELYCLRTQAATQQIRLEELALVLEKISSEIRNSSGYLGDISDRSKELFINNQTIGQYLMSQLDRNPNNKLKGQVFYRQDYEDEFNRIWETQARFHKELTSERLHIIRDIIIFFQRDLKSQKSNIAICEFENQKREITVDGKKKIIEFGPKVCPKSSPIFQEFKIWQTINNLKISNIYGEELSLSADERQILFEELSIRKKLTCAEILKLLHKDSKCSLNYKEIQGNTTISAIFDAFKEIILQSGHDNNNLNKASFKDTMLIIEPIFKMLGISTEILSLDCPTDSPSLKTCPIYQLWHLLYSYTGDNSKTGDSSLIKKLQRRYGFSKEYASIMSKISFDNDYGNLSAKAIMRILPHLRNGLQYSDACNAAGYNHSKRSLTKQDILNKVLVSHIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7791 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNGNGAIDNIDIAKKLYQSHLTPGEYVFNNLKQGIQYIPPFYRSDLINEFNKIVDCQTQFYPHLKNIDTGSLLKAKNCDIILDGQDVQRIKQKGNPSEKKRDLYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7792 - protein, 1081 aa, unidentified
  REGION 1..1081: note = Description of Unknown:uncultivated organism sequence
MQLLEKDPNTSLKNQVFYRQDYLDEFERIWETQATYHPELTAELKHEIRDIVIFYQRQLKSQKNLVGYCELESKQKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREIDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKCRGEKKQTVQLTPRCQLHNETVYGSMRCCVVKEEKISSSFTEEKIATVASPRYREALLKRLGEYGGNAKKAFTGRNSLEKNPLYLNDDHTLSVPAKVKTVTYETIFTQRKPIDKDLKVDKVIDEHVKKILEARLKEFGGDAKKAFSNLDENPIWLNRERGIQIKRVTIRGVSNAVALHDKHDVQGKPMCDSEGRRMPSDYVSTSGNHHVAIFRDANGNLQEHIVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7793 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVTEEITLEELARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAGQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKNLVGYCELESKQKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKCRGEKKQTVQLTPRCQLHNETVYGSMRCCVVKEEKISSSFTEEKIATVASPRYREALLKRLGEYGGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7794 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVTEEITLEELARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAGQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKNLVGYCELESKQKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIEFTKHSFIQYLNNLNARSNKAGSIYAIEQTCLYRDAHGKLRFMPPMPLDVFRAEARRQLQDILVSTKAKNKVVTRNINSIKCRGEKKQTVQLTPRCQLHNETVYGSMRCCVVKEEKISSSFTEEKIATVASPRYREALLKRLGEYGGNAKKAFTGRNSLEKNPLYLNDDHTLSVPAKVKTVTYETIFTQRKPIDKDLKVDKVIDEHVKKILEARLKEFGGDAKKAFSNLDENPIWLNRERGIQIKRVTIRGVSNAVALHDKHDVQGKPMCDSEGRRMPSDYVSTSGNHHVAIFRDANGNLQEHIVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7795 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALNNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKKKEVVVDGKKKTITTGLRVCPKSSPLFQSFKIWQTLNNVQVSGNIIPEKQLDLFGTVATYKYGRRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRHILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQKEYRRILQDEFGMPHVSRNDIIRYRLWLELKDNGYKTLYSQTYIPREKLFSKEFDVEHIIPQARLFDDSFSNKTLEARQANLEKSNATAFDYVQSKYGDEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPLPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKKILEARLKEFGGDTKKAFSNLDENPIWLNRERGIQIKRVTIRGVSNAVALHDKHDVQGKPMCDSEGRRMPSDYVSTSGNHHVAIFRDANGNLQEHVVSYFEATARAIQHLPIVDRDYNKDEGWQFLFTMKRNEYFVFPNEKTGFDPKEVDLLDSKNYAVISDNLFRVQKLATKDYFFRHHLETSVENNKSLCDITWKRITSLNKLQGIVKVRVNNIGQIVAVGEY

SEQ ID NO: 7796 - protein, 1392 aa, unidentified
  REGION 1..1392: note = Description of Unknown:uncultivated organism sequence
MKRILGLDLGTSSIGWALVNESEDEREQSSIIKLGVRVNPLTVDEQRNFEAGKPITTNAERTLKRSMRRNLQRYKLRRDNLIEILTEHGFITPETILAEQGNKSTFETYRLRAKAVTEEISLEELARVLLMINKKRGYKSSRKLDTNEDGKIIDGMEVAKQLYDEGLTPGQYMLRLMDSGKRYTPDFYRSDLKDEFGRIWDFQKTFYPELLTDELRQELAGKNEKQTWAICAKTFSLVGLKRTAKGEELKRENYKWRVDSLSEKMDLESLTVVLQKINGQINGSSGYLGEMSDRSKELYFKKQTVGQYLMSRLDKNSHYSLKNKVFYRQDYLDEFEMIWENQARYHSELTDSLKHEIRDVVIFYQRSLKSQKGLISFCEFENRQMETVKYGKKRLKTVGLRVCPKSSPLFQEFKIWQILNNIQVSGKVVRKQSVDLFGETVEMANGKRFLYQEEKEKLFRELNIKAKMSKAEVLKLLFKNHKELDLNYKEIEGNRTQAALFAAYQTIIDMSGHGTHDFSKMCADDVMDIVSNVFGGLEFGTDILCFDSSLEGKAFERQPAYRLWHLLYSFAGDNSKTGNEKLISKISELYGFDREYAAIIAGISFQLDYGSLSAKAIRKILPYMKEGNEYSVACGYAGYRHSKNSLTKEELANKLLCNRLKPLPRNSLRNPVVEKILNQMINVVNSVANVYGKPDEIRIEMARELKNSAKEREEMTKAISKATADHEYYRQILKNEFGIENVSRNDIIRYKLYMELKDKGFKTLYSNTYIPREKLFSKEFDIEHIIPQARLFDDSFSNKTIEVRSVNIEKGNMTAYDYVCGKYDADKVSAYKVRVEELFKNGTISKTKRDKLLMSEADIPSGFIERDLRDSQYIARKAREILESLVRTVVPTTGSITSRLREDWQLVDVMKELNWDKYNRLGLTDFVVDKDGRRIRRIKDWTKRNDHRHHAMDALTIAFTKPSYIQYLNNMNARSDKGSSIYAIEKKELYRDNGKLKFQPPMPLDVFRAEAKRHLDGILVSIKAKNKVVTRNTNVSKIKGGTKKKVQLTPRGQLHNKTVYGRIKRYVVKEEKVNASFDMQKIDTVANMRYRMALSDRLQQYGGNAKKAFTGSNSLQKNPLYVDDMHIIAVPERVKTVGFEYVYTIRKEVTPDLKIDKVVDSKVRNILKARLEQFGNDAKKAFVNLDENPIWLNKEKGIAIKRVTITGVSNALALHDKRDNSGKPMLDVNGHKMPVDFVSPSNNHHVAIYMDADGKMQDDIVSFYEATMRANQGYPVIDRDKNRSEGWQFLFTMKQNEYFVFPNEETGFDPNEIDLLDPNNYPIISPNLFRVQKLSKTEGRIYMFRHHLETTVDDKKELQEVTWKRINSLDKLKNVVKVRVDHVGRIVSVGEY

SEQ ID NO: 7797 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVLSLLRKGKNNIPDFYRSDLVAEFDKIWNFQRQFYPDVLTDSLKEELKGKGDKETWAICSKPFAIEGIKRNIKGWEQKKEDYAWRAESLQHKIDLERLAIVLQKVNGQIKNSSGYLGAISDRSKELFFNKLTVGQYQMAELDKNPNFSLKNQVFYRQDYLDEFERIWETQAKFHKELTPELKHIIRDIVIFYQRPLKSQKGLISLCELESREIEIERDGKKTKKTIGPRVCPKSSPMYQEFRIWQAINNLQVSGMVVADNQVDLFGKTIGKKFGKRFLEQEEKEILFKELNFKSKLTKKEILKLLFENYKELDLNYNEVKGNTTMAALLEVCSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACQYAGYRYSKRSLTKEEIEARPLKDKIDLLPRNSLRNPVVEKILNQMINVVNAVVDTYGSPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKDKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYEGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVTWKRINTLSKIKDIVKVRINQVGKIEDLGEY

SEQ ID NO: 7798 - protein, 1394 aa, unidentified
  REGION 1..1394: note = Description of Unknown:uncultivated organism sequence
MKNILGLDLGTNSIGWALVKERENDNEQSSIMRLGVREIYLTADEQSNFEKGKPITTNADRTQKRSMRRNLQRYKLRRDNLINVLKDNGLIKADTLLNENGNRTTFETYRLRAKAVTEEISLEEFARVLLMINKKRGYKSSRKAKSNDESGQLIDGMEVAKKLYDENLTPGQYVASLLRKGKNNIPDFYRSDLVAEFDKIWSFQRQFYPDMLTDSLKEELKGKGDKETWAICSKPFGIVGLKRKTKGWEQKKEDYSWRAESLQHKIDLERLAVVLQKVKGQIKNSSGYLGAISDRSKELFFNRLTVGQYLMAELDKNPNFSLKNQVFYRQDYLDEFERIWDTQAKFHKELTPELKHIIRDIVIFYQRPLKSQKGLISLCELESREIEIERNGKMVKKTIGPRVCPKSSPMYQEFRIWQTINNLQVSGMVVADGQVDLFGEKVGTKFGKRFLEQEEKEILFKELNFKNKMTKREILKLLFENYKELDLNYNEVKGNTTMAALLASCSKIIEMSGHGEYDFSKMSADEITGIVFPIFSGLGFSTDIFSFDSSVEGRAFDKQPSYMLWHLLYSYEGDKSKTGNECLINKISECYGFDKEYAAVIAGISFEPDYGSISVRAIHKILPYMKDGLGYSDACQYAGYRHSKRSLTKEEIQTKPLKDKIELLPRNSLRNPVVEKILNQMINVVNAVVDVYGKPDEIRVEMARELKKTKAQREETVKAIRKTTAENEKYRKVLEEEFGLKNVSRNDIIRYRLYLELKENGFKTLYSNTYIPREKLFSKEFDIEHIIPQAKLFDDSFSNKTLEARSVNIDKADSTAYDYVKVKYGEDGLEKYKEKINQLCEKKIISKTKLKRLLTTEEDIPDGFINRDLSNTQYIARKACEILEEITRRVVPTTGSVTSRLREDWQLVDMMKELNWDKYDRLGLTEIVEDKDGRRIRHIKDWTKRNDQRHHAMDALTIAFTKPVFIQYLNNLNARSDKGGSIYAIERKDLYRDNKGKLRFYPPMPLDEFRVEAKRHLENILVSIKAKNKVVTRNVNITKAKKAEKGKRKRIQPTPRGRLHNETIYGRIRQYATKEEKVNASFTEDKIMTVACKHYREALLMRLRQHDGDAKKAFTGKNSLAKNPLFTDNMHTEIVPEKVKTVTLAPLYTKREAISPDLKIDKVIDIGIKRLLQKRLEQYGGDMQKAFSNLDENPIWLDEEKGISIKRVTISSVSNAEALHDKRDNHGQLILDKDGKKLPTDFVQTSGNHHVAIFRDAEGNLQEHMVSFYEATARAIQHLPIIDKEYNKDLGWQFLFTMKQNEYFVFPNEETGFNPKEIDLLDPQNYALISPNLFRVQKLSSKDYFFRHHLETKVEYNKELFGITWKRINTLSKIKDIVKVRINQVGQIVSVGEY

SEQ ID NO: 7799 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFGINGMKRNGTAAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFAAITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTQHSFIQYLNNLNARSNKSGSIYAIEQTYLYRDAHGKLRFMPPMPLDVFRAEARRQLQGILVSTKAKNKVVTRNINSIKRRGEKKQTVQLTPRCQLHNETVYGSMRCCVVKEEKISSSFTEEKIATVASPRYREALFKRLGEYGGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNTVALHDKHDVQGKTMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7800 - protein, 725 aa, unidentified
  REGION 1..725: note = Description of Unknown:uncultivated organism sequence
MKKILGLDLGTTSIGWALVNEKENDNEQSSIIKLGVRVNPLSVDEQSNFEKGKAITTNADRTKKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQPFGIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFADITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQ

SEQ ID NO: 7801 - protein, 652 aa, unidentified
  REGION 1..652: note = Description of Unknown:uncultivated organism sequence
MPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNGTVYGSMRCCVVKEEKISSSFTEEKIATVASPRYREALLKRLGEYGGNAKKAFTGRNSLEKNPLYLNDDHTLSVPAKVKTVIYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISANLFRVQKITTKDYFFRHHLETSVENNKSLCDITWKRITSLNKLQGIVKVRVNNIGQIVAVGEY

SEQ ID NO: 7802 - protein, 1394 aa, unidentified
  REGION 1..1394: note = Description of Unknown:uncultivated organism sequence
MKKILGLDLGTTSIGWALVKEAEIAEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCGGKKYIPDFYPSDLNAEFEAVWNCQKQFYAEIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKMQTDLFGDSTECEHGTRTLTEEEKCDLYRELSIKESLSETEILKLLFGSKKGLSLNFRKVEGNRTMSLFVKACQTVLAINGYNDYDFSKMSYDKAMPIITQVFEALGFNTSFLTFDPTLDGKDFERQTAYQLWHLLYSYSGDNSATGNEKLIERLRNLLNMDRDSAAVFVSIPLEPDYGSLSVKAMRRILPHMMDGLEYSVACEYAGYRHSCRSLTKEEIAAKPLVETIPLLPRNSLRNPVVEKILNQMINVVNAVSDRYGKPDEIRIEMARELKKSAKEREQMTRDIARTNAENEKYRKALQEEFGIQNVSRNDIIRYRLYLELEANGFKTLYTRTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTVSSPQIREALLRRLAEFGGDAKKAFTGKNSLEKNPIYLDDSHTKQVPQKVKTVTLEEVFTIRKPVDKDLNVEKVVDLRVRKLLQERLAEYGGDAKKAFANLDENPVWLNRERGIAIKRVTIYGVSNATALHDKRDMHGKKMLNSNGISIPVDFVSTNNNHHVAIFRDKDGNLQEHVVSFFEATERAQQQLPIVDYEYNKHLGWQFLFTMKRNEYFVFPNEKTGFDPNEVDLLDPKNAEEISKNLFRVQKLATKNYCFRHHLETSSETPKELSGITYKWQLGLKGIVGIVKVRVNHLGEIVAVGEY

SEQ ID NO: 7803 - protein, 1398 aa, unidentified
  REGION 1..1398: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFGINGMKRNGTAAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNRTMAAFVKACQTIIVMSGHNEYDFAKLSYETIVSTINQIFNALGIKSGFLNFDPCLEGKAFEHQPAYQLWHLLYSYAGDNSATGNEKLITRIAETFVMEHNYAAVFAAITFMPDYGNLSAKAMRHILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKSGSIYAIEQTCLYRDAHGKLRFMPPMPLDVFRAEARRQLQDILVSTKAKNKVVTRNINSIKRRGEKKQTVQLTPRCQLHNETVYGSVRCCVVKEEKISSSFTEEKIATVASPRYREALLKRLGEYGGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTEFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 7804 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLAHGMRLNLSRYKQRRKELIKNLIRFKFISPDTVLCENGSNTTFETLRLRAKATTEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWKTQARFHKELTPERLHIIRDIIIFFQRDLKSQKSNIAICEFENQKREITVDGKKKIIEYGPKVCPKSSPIFQEFKIWQTINNLKISNIYGEELSLSSDERQILFEELSIRKKLTCAEILKLLHKDSKCSLNYKEIQGNTTISAIFDAFKEIILQSGHDNNNFNKASFKDTMLIIEPIFKMLRINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTNRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7805 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYAGIFTDELREALRSKNEKQTWAICAEPLVLKGIKRNGSTADQRVENYRWRTEAISKQLPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFERQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNVDTPKELSGITYARLSLKGIVGIVKVRVNHLGEIVAVGEY

SEQ ID NO: 7806 - protein, 1391 aa, unidentified
  REGION 1..1391: note = Description of Unknown:uncultivated organism sequence
MKKILGLDLGSNSIGWAIVNEKEREGETSSIVKLGVRVNPLTVDEQSNFEKGKPITTNSDRTLKRGMRRSLQRYKLRRNSLVSLLKANGWIDDDTILAEHGNNTTFETRRLRAKAVNGKISLEELARVLLLINKKRGYKSNRKAKQDGEDGRLIDSMDVAKKLYDGKLTPGQYALLLIKEGKKYVPDFYRSDMQEEFDRIWDFQRQFYPDILTDDLKSDLHDRNKSQTWAICAKPFGIKGIKRKVKGWELKVENFRWRDEALKRQVDLERLAVVLQEINGQLKNSSGYLGTISDRSKELYFRGMTVGQYQMAELDKNPNHSLKNEVFYRQDYLDEFERIWETQAEYHKELTPELKREVRDITIFYQRPLKSQKGLVAFCEFESSEVEIEENGKKKTRTVGLRVCPKSSPLFQEFKLWQVINNVQVSGPIVPEAQLDLFGTATAYKYGKRFLMQDEKDLLFKELSFKEKLTKKEILRLLFDNATELDLNYKEIKGDTTRAALLKACQVIVEMSGHGTYDFSKMSYDEITGVVEPVFNALGFNTDILHFDSSLEGKAFAAQPAYRLWHLLYSFEGDNSKTGNEKLIGKISSLYGFDKDYAAVIAGVTFEPDYGSLSAKAIRKILPYMKEGLGYSDACQYAGYRHSARSLTKEELDQKPLKDSIGLLPRGSLRNPVVEKILNQMINVVNSVIKIYGKPDEIRVEMARELKKNAAQRDEMVKAIKKANGENDEYRKTLQEEFGISNPSRNDIIKYRLYLELKENGFKTLYSDTYIQRERLFSKDFDVEHIIPQAKLFDDSFANKTLEARSANLEKGKMTAYDYVKEKYGETGLDAYTKRIDALCDKGAISKTKRKRLLTTEADIPGGFINRDLNETQYIARKAHEILEEVARTVTATTGSVTDRLREDWQLVDVMKELNWDKYDRLGLTETVTDRDGRRIRRIKDWTKRNDHRHHAMDALTIAFTKPSFIQYLNNLNARGNKGGSIYGIEQKELYRDHGGKLRFCPPMPLDEFRAEAKRQLESVLVSIKAKNKVVTRNVNVTKTKNGKHEVIQLTPRGQLHNETYYGRIWRYESKFEKVNASFDEEKIRTVAVKRYREALLERLRLCCNDPKKAFTGCNSLDKNPLFIDKMHTEKVPDKVKTVILEKVYTQRQEVNKDLNIDKVVDKKIKTLLQERLNQYGGDKQKAFSNLDENPIWLNKEKGIQVKRVTITGKSNVVALHDKHDHLGRLILDKDGNKQPVDFVSTSNNHHVAIFCDAEGNLQEHVVSFYEATARAIQHLPIIDKDYKKDEGWQFLFTMKQNEYFVFPNSETGFDPKEVELLDPKNYADISKNLYRVQKISTKNYFFRHHLETTVEENKELKGVTYKPQLGLNGIKGIVKVRVNHLGQIVSVGEY

SEQ ID NO: 7807 - protein, 1373 aa, unidentified
  REGION 1..1373: note = Description of Unknown:uncultivated organism sequence
MVNEKENDNEQSSIIKLGVRVNPLSVDKNEQSNFEKGKPITTNADRTKKRGARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQSFGIKGMKRNGTTAEQKAENYRWRSEALDKKIGLEELAIVLQKINGQIHGTSGNLGAISDRSKELYFNHQTVGQYQMQLLEKDPNTSLKNQVFYRQDYLDEFERIWETQATYHPELTAELKHEIRDIVIFYQRKSQKSLVGYCELESKPKEVVVNGKKKTITTGLRVCPKSSPLFQSFKIWQTLNNVKVSGNIIPEKQLDLFGTTATYKYGSRRLTEEEKQTLYKELSLKERMSAAEILKLLFKSGKGLSLNFREVDGNRTMAAFVKACQTIIVMSGHNEYDFAKLSYETVMSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNKYSVACEYAGYRHSRRSLTKEELDKKPLVDTLPLLPRNSLRNPVVEKILNQMINVVNEVSAKYVKPDEIRIEMARELKMSAKERKQMTADITRATAQQEEYRRILQDEFGMPHVSRNDIIRYRLWLELKDNGYKTLYSQTYIPREKLFSKEFDVEHIIPQARLFDNSFSNKTLEARQANLEKSNATAFDYVQSKYGEKGAKEYKERIDYLYADGVISKTKHDKLLMKEADIPEGPISRDLRDSQYIARKAREILESMVRVVVSTTGAVTARLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKKILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7808 - protein, 597 aa, unidentified
  REGION 1..597: note = Description of Unknown:uncultivated organism sequence
MSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7809 - protein, 1156 aa, unidentified
  REGION 1..1156: note = Description of Unknown:uncultivated organism sequence
MTVARQLYDEHLTPGQYVLNLLRKGKKYQPDFYPSDLTAELKAVWLTQQNYYPELLTQELYDAIKNKNEKQTWAICAKTFGINGMKRNGTMAEQTIENYRWRTEALEKKIGLEELAIVLQKINGQIRGTSGYLGEISDRSKELYFNHQTVGQYQMQLLEQNPNTSLKNQVFYRQDYLDEFERIWETQASYHPELTTELKHEVRDIVIFYQRQLKSQKGLVGYCELENDTKEVVVDGKKKTVTIGLRVCPKSSPLFQCFKIWQTINNVQVSGNIIPEKQLDLFGTVATYKYGSRCLTEEEKQTLYKELSLKERMKATEILKLLFKNAKGLSLNFHEVDGNRTMAAFVKACQTIISMSGHNEYDFAKLSHETTVSTITQIFDVLEIKSDFLNFDPCLEGKTFEQQPAYQLWHLLYSYTGDNSATGNDKLIAHIAKTFGMKHEYAAVFAAITFTPDYGNLSAKAMRRILPHMMDGNEYSVACEYAGYRHSRRSLTKEELGKKPLVDSLPLLPRNSLRNPVVEKILNQMINVVNGVSAQYGKPDEIRIEMARELKKSAKEREQMTADIARATAQQEEYKRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKRDKLLMKEANIPEGFINRDLRDSQYIARKAREILESMVRVVVPTTGAVTDRLREDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQDILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPIVDRDYKKAEGWQFLFTMKRNEYFVFPNEKTGFNP

SEQ ID NO: 7810 - protein, 556 aa, unidentified
  REGION 1..556: note = Description of Unknown:uncultivated organism sequence
MEALYVKGAISKTKRNRLLTVEADIPDGFINRDLNDTQYIARKAREILEEVVRTVTPTTGSVTDRLRDDWQLVDVMKELNWDKYDRLGLTEIVEDKDGRRIRRIKDWTKRNDHRHHAMDALTIAFTKPAYIQYLNNLNARSDRSGSIYAIERKELYRDRGGKLRFMPPMPLDELRREARRQLEAVLVSIKAKNKVVTRNINVTNAKGGGHRKVQLTPRGQLHNETIYGSIRRYATKEEKVNASFTEDKIMTVADKRYREALLERLRLCYGDPKKAFTGRNSLDKNPLFVGRMHTEKVPTKVKTVTLETIFTKRKEVNKDLKVDKVIDTRVRKILEERLRQYGGDAQAAFSNLDENPIWLNKEKGISIKRVTITGVNNAVALHDKRDNLGRLILDGNGNKQPSDYVSTSNNHHVAIFRDAEGNLQEHVVSFYEATARAIQHLPVIDRDYNKAVGWQFLFTMKQNEYFVFPNAETGFDPKEIDLLDPKNYAAISPNLFRVQKIATKNYFFRHHLETTVETPKELAGITYKPQLGLNGIKGIIKVRVNHLGQIVSVGEY

SEQ ID NO: 7811 - protein, 1390 aa, unidentified
  REGION 1..1390: note = Description of Unknown:uncultivated organism sequence
MKKILGLDLGTTSIGWALVNEKENDNEQSAIIKLGIRVNPLSVDEQSNFEKGKAITTNADRTLKRSARRNLQRFKLRRENLLTLLKEHGFITNETVLCEQGNRTTFETRRLRARAVTEEITLEELALVLLMINKKRGYKSSRKADSGEDGKLIDGMTVARQLYDEHLTPGQYVFNLLRKGKKYLPDFYPSDLTAELKAVWRTQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQLQLLEQNPNTSLKNQVFYRQDYLDEFERIWETQASYHPELTTELKHEVRDIVIFYQRQLKSQKGLVGYCELENDTKEVVVDGKKKTVTIGLRVCPKSSPLFQCFKIWQTINNVQVSGNIIPEKQLDLFGTVAAYKYGSRCLTEEEKQTLYKELSLKERMKATEILKLLFKNAKGLSLNFHEVDGNRTMAAFVKACQTIISMSGHNEYDFAKLSHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYRHSRRSLTKEELDKKPLVDSLPLLPRNSLRNPVVEKILNQMINVVNGVSAQYGKPDEIRIEMARELKKSAKEREQMTADIARATAQQEEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKHDKLLMKEANIPEGFINRDLRDSQYIARKAREILESMVRVVVPTTGAVTDRLREDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQDILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPVVDRDYKKAEGWQFLFTMKRNEYFVFPNEKTGFNPKEIDLLDPKNYAVISANLFRVQKLSTKYYCFRHHLETSVKEEKLLFDITWKRCRSPKELQGTIKVRVNNIGQIVAIGEY

SEQ ID NO: 7812 - protein, 1398 aa, unidentified
  REGION 1..1398: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFGIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRHILQDKFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKSGSIYAIEQTCLYRDAHGKLRFMPPMPLDVFRAEARRQLQNILVSTKAKNKVVTRNINSIKRRGEKKQTVQLTPRCQLHNQTVYGSVRCCVVKEEKISSSFTEEKIATVASPRYREALLKRLGEYGGNAKKAFTGRNSLEKNPLYLNDDHTLSVPAKVKTVTYETIFTQRKPIDKDLKVDKVIDEHVKEILEARLKEFGGNAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEHFVFPNEKTEFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 7813 - protein, 1393 aa, unidentified
  REGION 1..1393: note = Description of Unknown:uncultivated organism sequence
MKKILGLDLGTTSIGWAFVTEAENEKEKSSIIKLGVRVNPLTVDEQTNFEKGKAITTNADRTLKRTVRRNLQRYKLRRENLISLLKKEGFITEDSVLCEKGNNTTFETRRLRAKAVTEEISLEELARVLIMLNKKRGYKSSRKANSGEEGNLIDGMTVARKLYDEHLTPGQYTYQLLCKGKKYIPDFYPSDLIAEFEAVWNCQKQFYTDMLTDELREALRDKNEKQTWAICAAPLGLKGIKRNGTVADQRVENYRWRTEALTKQLPLEQVVIVLQKINSQIRGTSGYLGAISDRSKELYFNHLTVGQFQMKQLSENPNISLKNQVFYRQDYLDEFERIWEKQAKFHKELTEELKHELRDIIIFYQRPLKSQKSLISYCEFESSQKEVVVDGKKKTITIGLRVCPKSSPLFQCFKIWQSINNLQITGNVIPKQQLDLFGDTTEFDHGTRILTEEEKLDLYRELSIKESLSEAEIIKLLFGGKKGLSLNFHKVEGNRTMATFIKACHTILVINGYNDYDFSKISYDKTIAIITQVFDALGFKSGFLNFNPTLEGKGYERQDAYRLWHLLYSYSDDNSATGNEKLVERIGNLLNMDKESAAAFASITYESDYGSLSSKAMRRILPHMMDGLEYSVACEYAGYRHSRRSLTKEEIMSKPLVNTIPLLPRNSLRNPVVEKILNQMINVVNAVSESYGKPDEIRIEMARELKKSATEREQMTRDIARANIENDKYRKVLQEKFNIQNVSRNDIIRYRLYLELEANGFKTLYTQTYIPREKLFSKEFDIEHIIPQARLFDDSFSNKTLEARSANIEKGSTTAYDYVLAKYGEHGSNGAIAYKERIDHLYKDGKISKTKHDKLLMTTDDIPDGFINRDLRDTQYIARKAREILESTVRVVVPTTGSVTDRLREDWQLVDVMKELNWDKYDQLGLTEIVKDHDGRQIRRIKDWTKRNDHRHHAMDALTIAFTRHSYIQYLNNLNARSDKGGSIYAIEKKELYRDKNNKLRFIPPMPLGEFRVEARRHLENVLISIKAKNKVVTRNVNITRGSDGKTHRTVQLTPRGQLHNETVYGHRCQCIVKEEKVCSAFNMEKINTVSNPQFREALLRRYAEFGDAKKAFTGKNSLDKNPIYLNDDHTKQVPQKVKTVTFEEVFTIRKPIDKDLNIDKVVDAHIREILQQRLSEYGDDAKKAFANLDENPIWLNRERGIAIKRVTIYGVSNAIALHDRRDMQGNKILKSNGTPTPADYVSTSNNHHVAIFLDEKGNLQEHVVSFFEATERSRQHLPIVDREYNKHLEWKFLFTMKRNEYFVFPNEKTGFNPNEIDLLDPNNAAEISKNLFRVQKLATKNYFFRHHLETNVDTPKELSGITYKSQLGLKGIVGIVKVRINHLGQIVAVGEY

SEQ ID NO: 7814 - protein, 1398 aa, unidentified
  REGION 1..1398: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNRTMAAFVKACQTIIVMSGHNEYDFAKLSYETIVSTINQIFNALGIKSGFLNFDPCLEGKAFEHQPAYQLWHLLYSYAGDNSATGNEKLITRIAETFGMEHNYAAVFAAITFMPNYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSDATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKSGSIYAIEQICLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGDAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSSNHHVAIFRDANGNLQEHIVSYFEATARAIQHLPIVDRNYSKDEGWQFLFTMKRNEYFVFPNEKTGFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 7815 - protein, 1373 aa, unidentified
  REGION 1..1373: note = Description of Unknown:uncultivated organism sequence
MVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKAGNIYAIEQTCLYRDAHGKLRFMPPMPLDVFRAEARRLLQDILVSTKAKNKVVTRNINSIKRRGEKKQTVQLTPRCQLHNETVYGSVRCCVVKEEKISSSFTEEKIATVASPRYREALLKRLGEYGGNAKKAFTGRNSLEKNPLYLNDDHTLSVPTKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSKGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7816 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSVRCCVVKEEKISSSFTEEKIATVASPRYREALLKRLGENGGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSKGRRMPSDYVSTSNNHHVAIFRDANGNLQEHVVSYFEATARAIQHLPIVDRNYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7817 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCGGKKYIPDFYPSDLNAEFEAVWNCQKQFYAGIFTDELREALRSKNEKQTWAICAEPLGLKGIKRNGSTADQRVENYRWRTEAISKQLPLEQVAVVLQKINGQIAGTSGYLGAISDRSKELYFNHQTVGQFQMKQLSDNPNISLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKAQLDLFGDTTECEHGTRTLTEEEKSDLYRELSIKESLSETEILKLLFGGNKGLSLNFRKVEGNRTMSLFVKACQTVLAINGYNDYDFSKMSYDKAMPIITQVFEALGFNTSFLTFDPTLDGKDFERQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDFVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLSLKGIVGIVKVRVNHLGEIVAVGEY

SEQ ID NO: 7818 - protein, 1391 aa, unidentified
  REGION 1..1391: note = Description of Unknown:uncultivated organism sequence
MKKILGLDLGTGSIGWAVVNEKDKEGESSSIVKLGVRVNPLTVDEQTNFEKGKPITTNADRTLKRGMRRNLQRYRLRRDCLVKLLKDNGWINDDTILAEHGNSTTFETRRLRAKAAAEEISLGQLARVLLMINKKRGYKSNRKAKQDGEDGRLIDSMDVAKKLCDENLTPGQYVLSLMKEGQKYVPDFYRSDLQEEFDRIWNFQQQFHPDILTDSLKSELHDKNKSQTWAICAKPFCIKGIKRETKGWEQKKENYVWRDEALKRQMDFERLAVVLQEVNGQIKNSSGYLGAISDRSKELYFRGMTVGQYQMAELDEDPNHSLKNEVFYRQDYLDEFERIWETQAKFHKELTPELKHDVRDTVIFYQRPLKSQKGLISFCEFESREVEVDVDGKKKTRTVGLRVCPKSSPLFQEFKLWQVINNVQVSGPIVPEAQPDLFGMSASYKYGKRFLEKEEKDVLFKELSCREKMNKKDILKLLFKNYSELDLNYKEIKGDTTRAALLKACQSILEMSGHDTYDFAKMSADEIMSIIEPVFKMLGINTGILHFDSSLEGKAFIAQPAYRLWHLLYSYEGDKSKTGNEKLVEKISSLFGFSREYAEVIASLTFDSDYGSLSAKAMRKILPYMREGVEYSEACRLAGYRHSARSLTREELDSKPLKDRVDLLPRGSLRNPVVEKILNQMINVVNSAIKTYGRPDEIRIEMARELKKTAAQREDMVKAIKKVSDANEEYRKTLQEEFGIPNPSRNDIIKYRLYLELKENVYKTLYSNTYIQRERLFSKDFDVEHIIPQAKLFDDSFANKTLEARSANLEKSNLTAFDYVKGKYGEAGLDDYKKRVEALCDKGAISKTKRKRLLTTEADIPDGFINRDLNDTQYIARKAREILEEVVRTVTATTGSVTDRLREDWQLVDVMKELNWDKYDRLGLTEIVTDRDGRRIRHIKDWTKRNDHRHHAMDALTIAFTKPSFIQYLNNMNARSDKGGSIYGIERKELYRDGNGKLRFCPPMPLDEFRAEAKRLLEGVLVSIKAKNKVVTRNVNITKAKKGKHEKVQLTPRGQLHNETIYGCIRRYNPQYEKVNASFNEEKIKTVAVKRYREALLERLRLCYGDPKKAFTGRNALDKNPLFTDKTHTEKVPLKVKTVTLETVYTQRQEVNKDLNLDKVVDKKVKTLLEERLQQYGGDKVKAFSNLDENPIWLNKEKGIQVKRVTITGKSNVVALHDKRDNLGRLILDKDGNKQPVDFVSTSNNHHVAIFRDVEGNLQEHVVSFYEATARAIQHLPVIDKDYKKDEGWQFLFTMKQNEYFVFPNSGTGFDPKEIDLLDPRNYAEISKNLYRVQKLSSKYYVFRHHLETSVEDKKELKGIAWKNIRTPEGLGELVKVRVNHLGQIVSVGEY

SEQ ID NO: 7819 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCKGKKYIPDFYPSDLNAEFEAVWNCQKQFYADIFTDELREALRRKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNISLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFECQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVDKVVDQRVRKLLQERLAEYGGDAKKAFANLDENPIWLNRERGIAIKRVTIYGVSNATALHDKRDMHGKKMLNSNGMSIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLGLKGIVGIVKVRVNHLGEIVAVGEY

SEQ ID NO: 7820 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKQKEVVVDGKKKTITTGLRVCPKSSPLFQSFKIWQTLNNVQVSGNIIPEKQLDLFGTVATYKYGSRCLTEEEKQTLYKELSLKERMSAAEILKLLFKSGKGLSLNFREVDGNHTMAAFVKACQTIIVMSGHNEYDFAKLSYETVVSTINQIFNVLGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNKVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGDEGAKEYKERIDYLYADGVISKTKHDKLLMKEADIPEGFINRDLRDSQYIARKAREILESLVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSGNHHVAIFRDANGNLQEHVVSYFEATARAIQHLPIVDRDYNKDEGWQFLFTMKRNEYFVFPNEKTGFDPKEIDLLDPKNYAEISDNLFRVQKITTKDYFFRHHLETSVENNKSLCDITWKRCRSPKELQGIVKVRVNNIGQIVAVGEY

SEQ ID NO: 7821 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGESVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKKEITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7822 - protein, 895 aa, unidentified
  REGION 1..895: note = Description of Unknown:uncultivated organism sequence
MSAFVNACRQVIYMSGHDDIDFSKESAQYTTDTIKKVFGTIGAHADFLTFDPCLDGKEFAQQPAYRLWHLLYSYTGDNSATGDECLKERIADICGLDKEYASAFASIALQDDYGSLSAKAMRKILPFMMDGNEYSVACEYAGYRHSKRSLTKEELDNKPLVNTIPLLKRNSLRNPVVEKILNQMINVVNTVSETYGKPDEIRIEMARELKKSAKEREQMTKDMNDAKKKNDEYKQVLQSEFGITNPSRNDVIRYRLYKELEQNGFKTIYTQTYIPKDKLFSKEFDIEHIIPQARLFDDSMSNKTIEARQANIEKGSATAYDYVLGKYGKQGAEEYKQRVDKMLEDGKISKTKQKKLLMREQDIPEGFIDRDLRDSQYIARKAREILESMVRTVVATTGSVTDRLREDWQLVDVMKELNWDKYDRLGLTETITDHDGRQIRRIKDWTKRNDHRHHAMDALTIAFTRHSFIQYLNNMNARSDKSSSIYGIEQKELSRDSHGKLRFVPPMPLNEFRSEAKKHLEDILVSIKAKNKVMTKNPNKTKCAKGKTKTTLQLTPRGQLHNETIYGRIRQYATKEERVGSAFNAEKIATVANKRLREALAARLRQFDGDPKKAFTGQNSLEKKPIYLDAAHTVCVPPKVKTVTLKPTYTLRKEVNKDLNVEKVIDPHIRRILKERLKEYNKNAKEAFSNLEENPIWLNKERGIAIKRVTISGISNAIALHDKHDHHGKKLLDSEGRPMPTDFVSTSNNHHVAIFRDAEGNLQEHIVSFFEATMRASQHLPVIERDYNKELGWQFLFTMKQNEYFVFPNEKTGFNPNETDLLDPKNYAEISRNLFRVQKLATKDYWFRHHLETTTNTTKELSNLIWRRVTALNKLNGIIKVRVNHIGQIVAVGEY

SEQ ID NO: 7823 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKKEITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7824 - protein, 537 aa, unidentified
  REGION 1..537: note = Description of Unknown:uncultivated organism sequence
MTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLAEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDFVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLSLKGIVGIVKVRVNHLGEIVAVGEY

SEQ ID NO: 7825 - protein, 1390 aa, unidentified
  REGION 1..1390: note = Description of Unknown:uncultivated organism sequence
MKKILGLDLGTTSIGWALVNEKENDNEQSSIIKLGVRVNPLSVDKNEQSNFEKGKPITTNADRTKKRGARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQSFGIKGMKRNGTTAEQKAENYRWRSEALDKKIGLEELAIVLQKINGQIHGTSGNLGAISDRSKELYFNHQTVGQYQMQLLEKDPNTSLKNQVFYRQDYLDEFERIWETQATYHPELTAELKHEIRDIVIFYQRKSQKSLVGYCELESKPKEVVVNGKKKTITTGLRVCPKSSPLFQSFKIWQTLNNVKVSGNIIPEKQLDLFGTTATYKYGSRRLTEEEKQTLYKELSLKERMSAAEILKLLFKSGKGLSLNFREVDGNRTMAAFVKACQTIIVMSGHNEYDFAKLSYETVMSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNKYSVACEYAGYRHSRRSLTKEELDKKPLVDTLPLLPRNSLRNPVVEKILNQMINVVNEVSAKYVKPDEIRIEMARELKMSAKERKQMTADITRATAQQEEYRRILQDEFGMPHVSRNDIIRYRLWLELKDNGYKTLYSQTYIPREKLFSKEFDVEHIIPQARLFDNSFSNKTLEARQANLEKSNATAFDYVQSKYGEKGAKEYKERIDYLYADGVISKTKHDKLLMKEADIPEGPISRDLRDSQYIARKAREILESMVRVVVSTTGAVTARLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKKILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7826 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLAHGMRLNLSRYKQRRKELIKNLIRFKFISPDTVLCENGSNTTFETLRLRAKAATEGITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRTQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7827 - protein, 1069 aa, unidentified
  REGION 1..1069: note = Description of Unknown:uncultivated organism sequence
MFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFECQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLAKYGEHGDNGSIKYRERIDTLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDFVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNVDTPKELSGITYARLSLKGIVGIVKVRVNHLGEIVAVGEY

SEQ ID NO: 7828 - protein, 1373 aa, unidentified
  REGION 1..1373: note = Description of Unknown:uncultivated organism sequence
MVNEKENDNEQSSIIKLGVRVNPLSVDEQSNFEKGKAITTNADRMLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQPFGIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKQKEVVVDGKKKTITTGLRVCPKSSPLFQSFKIWQTLNNVQVSGNIIPEKQLDLFGTVATYKYGNRRLTEEEKQTLYKELSLKERMSPAEILKLLFKSGKGLSLNFREVDGNRTMAAFVKACQTIIVMSGHNEYDFAKLSYETVMSTINQIFNALGIKSGFLNFDPCLEGKAFEHQPAYQLWHLLYSYAGDNSATGNEKLIARIAETFGMEHNYAAVFAAITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIGYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7829 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQPFGIKGMKRNGTAAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFAAITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARKANLEKSDATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRLLQGILVSTKAKNKVVTRNINSIKRRGEKKQTVQLTPRCQLHNETVYGSMRCCVVKEEKISSSFTEEKIATVASPRYREALLKRLGENGGNAKKAFTGRNSLEKNPLYLNDDHTLSVPAKVKTVTYETIFTQRKPIDKDLKVDKVIDEHVKEILEARLKEFGGDAKKAFSNLDDNPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEFDLLDPKNYAVISDNLFRVQKITTKDYFFRHHLETSVENNKSLCDITWKRITSLNKLQGIVKVRVNNIGQIVAVGEY

SEQ ID NO: 7830 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWKTQARFHKELTPERLHIIRDIIIFFQRDLKSQKSNIAICEFENQKREITVDGKKKIIEYGPKVCPKSSPIFQEFKIWQTINNLKISNIYGEELSLSSDERQILFEELSIRKKLTCAEILKLLHKDSKCSLNYKEIQGNTTISAIFDAFKEIILQSGHDNNNFNKASFKDTMLIIEPIFKMLRINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSQRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7831 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKALYSQSLITDDILFSKEIEIEHIIPQARLFDDSLSNKTLEFHNINQNKSNQTAYDYILSEFGEDYAVQYKKRIDDLLRNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKLSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNAPLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRITSLKALENVIKVRVNNIGQIVAVGEY

SEQ ID NO: 7832 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNCTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQPFGIKGMKRNGTAAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETIVSTINQIFNALGIKSGFLNFDPCLEGKAFEHQPAYQLWHLLYSYAGDNSATGNEKLITRIAETFGMEHNYAAVFAAITFMPNYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKSGSIYAIEQICLYRDAHGKLRFMPPMPLDVFRAEARRQLQDILVSTKAKNKVVTRNINSIKRRGEKKQTVQLTPRCQLHNETVYGSLRCCVVKEEKISSSFTEEKIATVASPRYREALLKRMGEYGGNAKKAFTGRNSLEKNPLYLNDDHTLSVPAKVKTVTYETIFTQRKPIDKDLKVDKVIDEHVKEILEARLKEFGGDAKKAFSNLDENPIWLNSERGIQIKRVTIRGVSNAVALHDKHDMQGKPMCDSEGRRMPSDYVSTSSNHHVAIFRDANGNLQEHVVSYFEATARAIQHLPIVDRDYNKDEGWQFLFTMKRNEYFVFPNEKTGFDPKEFDLLDPKNYAVISDNLFRVQKITTKDYFFRHHLETNVENNKSLCDITWKRITSLNKLQGIVKVRVNNIGQIVAVGEY

SEQ ID NO: 7833 - protein, 1393 aa, unidentified
  REGION 1..1393: note = Description of Unknown:uncultivated organism sequence
MKKILGLDLGTTSIGWALVKEAEIAEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYAEIFTDELREALRSKNEKQTWAICAEPLGLKGIKRNGSTADQRVENYRWRTEAISKQMPLEQVAVVFQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQPDLFGDSTECEHGTRTLTEEEKCDLYRELSIKESLSETEILKLLFGSKKGLSLNFRKVEGNRTMSLLVKACQTVLAINGYNDYDFSKMSYDKAMPIITQVFEALGFNTSFLTFDPTLDGKDFERQAAYQLWHLLYSYSGDNSATGNEKLIERLCAILNMDRDSAAVFASITFAPDYGSLSAKAMRRILPHMMDGLEYSVACEYAGYRHSRRSLTKEEIAAKPLVDTIPLLPRNSLRNPVVEKILNQMINVVNAVSDRYGKPDEIRIEMARELKKNAKEREQMTRDIARANAENEKYRKILQEKFNKPNVSRNDIIRYRLYLELEANGFKTLYTQTYIPREKLFSKEFDIEHIIPQARLFDDSFSNKTLEARSANIEKGSTTAYDYVLAKYGEHGDNGAIKYRERIDTLYKEGVISKTKHDKLLMTTAEIPDGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTRQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNVDTPKELSGITYARLSLKGIVGIVKVRVNHLGEIVAVGEY

SEQ ID NO: 7834 - protein, 1373 aa, unidentified
  REGION 1..1373: note = Description of Unknown:uncultivated organism sequence
MVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSVRCCVVKEEKISSSFTEEKIATVASPRYREALLKRLGENGGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSKGRRMPSDYVSTSNNHHVAIFRDANGNLQEHVVSYFEATARAIQHLPIVDRNYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7835 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKQKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKNWTKRNDHRHHAMDALTIAFTKHSFIQYLNNLNARSNKSGSIYAIEQTCLYRDAHGKLRFMPPMPLDVFRAEARRQLQDILVSTKAKNKVVTRNVNSIKRRGEKKQTVQLTPRCQLHNETVYGGMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKKILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEVDLLDPKNYAVISDNLFRVQKITTKDYFFRHHLETSVENNKSLCDITWKRCRSPKELQGIVKVRVNNIGQIVAVGEY

SEQ ID NO: 7836 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKPITTNADRTQKRSMRRNLQRYKLRRDSLISLLKDYGFITAETLLNENGNRTTFETYRLRAKAVTEEISLEEFARVLLMINKKRGYKSSRKAKSNDESGQLIDGMEVAKKLYDENLTPGQYVASLLRKGKNNIPDFYRSDLVAEFDKIWSFQRQFYPDMLTDSLKEELKGKGDKETWAICSKPFGIVGLKRKTKGWEQKKEDYSWRAESLQHKIDLERLAVVLQKVKGQIKNSSGYLGAISDRSKELFFNRLTVGQYLMAELDKNPNFSLKNQVFYRQDYLDEFERIWDTQAKFHNELTPELKHIIRDIVIFYQRPLKSQKGLISLCELESREIEIERNGKMVKKTIGPRVCPKSSPMYQEFRIWQTINNLQVSGMVVADGQVDLFGEKVGTKFGKRFLEQEEKEILFKELNFKNKMTKREILKLLFENYKELDLNYNEVKGNTTMAALLASCSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLSRNSLRNPVVEKILNQMINVVNAVVDTYGSPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYEGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVTWKRINTLSKIKDIVKVRINQVGKIEDLGEY

SEQ ID NO: 7837 - protein, 1381 aa, unidentified
  REGION 1..1381: note = Description of Unknown:uncultivated organism sequence
MVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGISVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKQKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSTKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQKEYRRILQDEFGMPHVSRNDIIRYRLWLELKDNGYKTLYSQTYIPREKLFSKEFDVEHIIPQARLFDDSFSNKTLEARQANLEKSNATAFDYVQSKYGDEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKNWTKRNDHRHHAMDALTIAFTKHSFIQYLNNLNARSNKSGSIYAIEQTCLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKEILEARLKEFGGDVKKAFSNLDENPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISDNLFRVQTMSKLQYGNSIVRDYKFRHHLETTLNDNKELRDITYKQFKSLNFADTIVKVRVNNIGQIVAVGEY

SEQ ID NO: 7838 - protein, 837 aa, unidentified
  REGION 1..837: note = Description of Unknown:uncultivated organism sequence
MKKILGLDLGTTSIGWALVKEAEIEEEKSSIIKLGVRVNLLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYAGIFTDELREALRSKNEKQTWAICAEPLGLKGIKRNGSTADQRVENYRWRTEAISKQLPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKAQLDLFGDTTECEHGTRTLTEEEKSDLYRELSIKESLSETEILKLLFGSKKGLSLNFRKVEGNRTMSLFVKACQTVLAINGYNDYDFSKMSYDKAMPIITQVFEALGFNTSFLTFDPTLDGKDFERQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKSAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGTRLPTTMCLQNTVSKGTMAPLNTRNA

SEQ ID NO: 7839 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7840 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQPFGIKGMKRNGTAAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFAAITFMPDYGNLSAKAMRRILSYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARKANLEKSDATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKNWTKRNDHRHHAMDALTIAFTKHSFIQYLNNLNARSNKAGSIYAIEQTCLYRDAHGKLRFMPPMPLDVFRAEARRLLQDILVSTKAKNKVVTRNINSIKRRGEKKQTVQLTPRCQLHNETVYGSVRCCVVKEEKISSSFTEEKIATVASPRYREALLKRLGENGGNAKKAFTGRNSLEKNPLYLNDDHTLSVPAKVKTVTYETIFTQRKPIDKDLKVDKVIDEHVKEILEARLKEFGGDAKKAFSNLDDNPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEFDLLDPKNYAVISDNLFRVQKITTKDYFFRHHLETSVENNKSLCDITWKRITSLNKLQGIVKVRVNNIGQIVAVGEY

SEQ ID NO: 7841 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYAGIFTDELREALRSKNEKQTWAICAEPLGLKGIKRNGSTADQRVENYRWRTEAISKQLPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKSDLYRELSIKESLSETEILKLLFGSKKGLSLNFRKVEGNRTMSLFVKACQTVLVINGYNDYDFSKQPYDKAMQIITQVFEALGFNTSFLTFDPTLDGKDFERQTAYQLWHLLYSYSGDNSATGNEKLIERLCAILNMDRNSAAVFASITFEPDYGSLSAKAMRRILPHMMDGLEYSVACEYAGYRHSRRSLTKEEIAAKPLVDTIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSAKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLAEFGGDAKKAFTGKNSLEKNPIYLDDSHTKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLNSNGISIPVDFVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLSLKGIVGIVKVRVNHLGEIVAVGEY

SEQ ID NO: 7842 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGISVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVSYRQDYLDEFERIWETQATYHPELTAELKHEIRDIVIFYQRQLKSQKNLVGYCELESKQKEVVVDGKKKTITTGLRVCPKSSPLFQSFKIWQTLNNVQVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSVTGNEKLITRIAETFGMEHDYAAVFAAITFMPDYGNLSAKAMRRILPYMMDGNEYSVACEYAGYRHSRRSLTKEELDKKPLVDTLPLLPRNSLRNPVVEKILNQMINVVNELSAQYGKPDEIRIEMARELKKSAKEREQMTADITRATAQQKEYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQGILVSTKAKNKVVTRNINSIKCRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQCKPIDKDLKVDKVIDEHVKKNLEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISDNLFRVQKLSTKYYCFRHHLETNVEEEKLLFDITWKRCRSPKELQGIVKVRVNNIGQIVAVGEY

SEQ ID NO: 7843 - protein, 1390 aa, unidentified
  REGION 1..1390: note = Description of Unknown:uncultivated organism sequence
MKKILGLDLGTTSIGWALVNEKENDNEQSAIIKLGVRVNPLSVDEQSNFEKGKAITTNADRTLKRSSRRNLQRFKLRRQNLLTLLKEHGFITNETILCEQGNRTTFETRRLRARAVTEEITLEELARVLLMINKKRGYKSSRKADSGEDGKLIDGMTVARQLYDEHLTPGQYVLNLLRKGKKYLPDFYPSDLTAELKAVWRTQQTYYPELLTQELYDAIKNKNEKQTWAICAKTFGINGMKRNGTMAEQTIENYRWRTEALEKKIGLEELAIVLQKINGQIRSTSGYLGEISDRSKELYFNHQTVGQYQLQLLEQNPNTSLKNQVFYRQDYLDEFERIWETQASYHPELTTELKHEVRDIVIFYQRQLKSQKGLVGYCELENDTKEVVVDGKKKTVTIGLRVCPKSSPLFQCFKIWQTINNVQVSGNIIPEKQLDLFGTVATYKYGSRCLTEEEKQTLYKELSLKERMKATEILKLLFKNAKGLSLNFHEVDGNRTMAAFVKACQTIISMSGHNEYDFAKLSHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYKHSRRSLTKEELDKKPLFDSLPLLPRNSLRNPVVEKILNQMINVVNGVSAQYGKPDEIRIEMARELKKSAKEREQMTADIARATAQQDEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKHDKLLMKEANIPEGFINRDLRDSQYIARKAREILESMVRVVVPTTGAVTDRLREDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQDILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPIIDRDYKKAEGWQFLFTMKRNEYFVFPNEKTGFNPKEIDLLDPKNYAVISANLFRVQKLATKDYFFRHHLETSVKEEKLLFDITWKRCRSPKELQGTIKVRVNNIGQIVAIGEY

SEQ ID NO: 7844 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGISVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVSYRQDYLDEFERIWETQATYHPELTAELKHEIRDIVIFYQRQLKSQKNLVGYCELESKQKEVVVDGKKKTITTGLRVCPKSSPLFQSFKIWQTLNNVQVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSVTGNEKLITRIAETFGMEHDYAAVFAAITFMPDYGNLSAKAMRRILPYMMDGNEYSVACEYAGYRHSRRSLTKEELDKKPLVDTLPLLPRNSLRNPVVEKILNQMINVVNELSAQYGKPDEIRIEMARELKKSAKEREQMTADITRATAQQKEYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQGILVSTKAKNKVVTRNINSIKCRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQCKPIDKDLKVDKVIDEHVKKILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEIDLLDPKNYAVISDNLFRVQKLSTKYYCFRHHLETNVEEEKLLFDITWKRCRSPKELQGIVKVRVNNIGQIVAVGEY

SEQ ID NO: 7845 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNENTGFNPAEIDLLNPDNNKIISPNLFRVQKISPGDYFFRHHLETTVDANNALKGTTWIRITSLKALENVIKVRVNNIGQIVAVGEY

SEQ ID NO: 7846 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNCTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQPFGIKGMKRNGTAAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFAAITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDIIRYRLWLELKDNGYKTLYSQIYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSLRCCVVKEEKISSSFTEEKIATVASPRYREALLKRMGEYGGNAKKAFTGRNSLEKNPLYLNDDHTLSVPAKVKTVTYETIFTQRKPIDKDLKVDKVIDEHVKEILEARLKEFGGDAKKAFSNLDENPIWLNSERGIQIKRVTIRGVSNAVALHDKHDMQGKPMCDSEGRRMPSDYVSTSSNHHVAIFRDANGNLQEHVVSYFEATARAIQHLPIVDRDYNKDEGWQFLFTMKRNEYFVFPNEKTGFDPKEFDLLDPKNYAVISDNLFRVQKITTKDYFFRHHLETNVENNKSLCDITWKRITSLNKLQGIVKVRVNNIGQIVAVGEY

SEQ ID NO: 7847 - protein, 1393 aa, unidentified
  REGION 1..1393: note = Description of Unknown:uncultivated organism sequence
MKRILGLDLGTTSIGWALVNEGENYNEKSSIVKLGVRVNPLSSDEKNEFETGKALTTNAERTNKHGMRINLQRYKQRRANLVRCLKENGIIDDEALLFEHGNSSTFQTYRARAKAVDEEISLADFSRVLLMINKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNVSLRNITFYRQDYIDEFNAIWQCQSKYHKELTPALKDEIEKHIIFYQRDLKSCKSLVNHCEFEQSEKEIAVDGKKRKITIGLRACPKSSPLFQTFRTWQKLNDIMVSPSDGKNKSSAMNSVPGLFNDLKTWRLERFLKQEEKEKLFEELSVKGKLTKKEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGVGYSAACEEAGYKHSPRSLTKEELKAKVYAGKMDVVKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGVNKKEQLTPRGKLHNETVYGKISRYQTEMKRVGGSFTEDVVLSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDIAGRPMLDEDGKPVGNDYVNTSNNHHVAIFTDSEGNLQEHVVSFYEATAMAILGYPVVDRQYNKGLGWKFLFSMNQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7848 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLQCRGKKYIPDFYPSDLNAEFEAVWNCQKQFYAEIFTDELREALRSKNEKQTWAICAEPLGLKGIKRNGSTADQRVENYRWRTEAISKQLPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFERQTAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIRYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVEKVVDQRVRKLLQERLAEYGGDAKKAFANLDENPIWLNRERGIAIKRVTIYGVSNATALHDKRDMHGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7849 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWKTQARFHKELTPERLHIIRDIIIFFQRDLKSQKSNIAICEFENQKREITVDGKKKIIEYGPKVCPKSSPIFQEFKIWQTINNLKISNIYGEELSLSSDERQILFEELSIRKKLTCAEILKLLHKDSKCSLNYKEIQGNTTISAIFDAFKEIILQSGHDNNNFNKASFKDTMLIIEPIFKMLRINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRMLTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7850 - protein, 1390 aa, unidentified
  REGION 1..1390: note = Description of Unknown:uncultivated organism sequence
MKKILGLDLGTTSIGWALVNEKENDNEQSAIIKLGVRVNPLSVDEQSNFEKGKAITTNADRTLKRSSRRNLQRFKLRRENLLTLLKEHGFITDETVLCEQGNRTTFETRRLRARAVTEEITLEELARVLLMINKKRGYKSSRKADSGEDGKLIDGMTVARQLYDEHLTPGQYVLNLLRKGKKYLPDFYPSDLTAELKAVWRTQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQMQLLEQNPNTSLKNQVFYRQDYLDEFERIWETQASYHPELTTELKHEVRDIVIFYQRQLKSQKGLVGYCELENDTKEVVVDGKKKTVTIGLRVCPKSSPLFQCFKIWQTINNVQVSGNIIPEKQLDLFGTVATYKYGSRCLTEEEKQTLYKELSLKERMKATEILKLLFKNAKGLSLNFHEVDGNRTMAAFVKACQTIIAISGHNEYDFAKLSHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYRHSRRSLTKEELDKKPLVDSLPLLPRNSLRNPVVEKILNQMINVVNGVSAQYGKPDEIRIEMARELKKSAKEREQMTADIARATAQQEEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKRDKLLMKEANIPEGFINRDLRDSQYIARKAREILESMVRVVVPTTGAVTDRLREDWQLVDIMKELNWDKYDKLGLTETFKDHDGRQIKRIKDWTKRNDHRHHAMDALTIAFTRHSFIQYLNNLNARSNKAGSIYAIEQTCLYRDAHGKLRFVPPMPLDVFRAEARRQLQDILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFETTARAIQHLPIVDRDYKKAEGWQFLFTMKRNEYFVFPNEKTGFSPKEIDLLDPKNYAVISANLFRVQKLTTKDYFFRHHLETSVKEEKLLFDITWKRITSLNKLQGIIKVHVNNIGQIVAIGEY

SEQ ID NO: 7851 - protein, 698 aa, unidentified
  REGION 1..698: note = Description of Unknown:uncultivated organism sequence
MARELKKSAKEREQMTADITRATAQQKEYRRILQDEFGMPYVSRNDIIRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGPISRDLRDSQYIARKAREILESMVRVVVSTTGAVTARLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQGILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKEILEARLKEFGGDVKKAFSNLDENPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISDNLFRVQTMSKLQYGNSIVRDYKFRHHLETTLNDNKELRDITYKQFKSLNFADTIVKVRVNNIGQIVAVGEY

SEQ ID NO: 7852 - protein, 699 aa, unidentified
  REGION 1..699: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVTEEITLEELARVLLMINKKRGYKSSRKADSGEDGKLIDGMSVARQLYEQHLTPGQYVLNLLRNGKKYLPDFYPSDLTAELKAVWHAQQAYYSELLTQDLFDALKNKNEKQTWAICAQPFGIKGMKRNGTTAEQKAENYRWRSEALDKKIGLEELAIVLQKINGQIHGTSGNLGAISDRSKELYFYHQTVGQYQMQLLEKDPNTSLKNQVFYRQDYLDEFERIWETQATYHPELTVELKHEIRDIVIFYQRQLKSQKSLVGYCELESKPKEVVVNGKKKTITTGLRVWPKSSPLFQSFKIWKTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMERSYAAVFAAITFMPDYGNLSAKAMRRILPYMMDGNEYSVACEYAGYRHSRRSLTKEELDKKPLVDTLPLLPRNSLRNPVVEKILNQMINVVNKVSAQYGKPDEIRI

SEQ ID NO: 7853 - protein, 1393 aa, unidentified
  REGION 1..1393: note = Description of Unknown:uncultivated organism sequence
MENVKHTSMKKILGLDLGTNSTGWALVNEAENTAEKSSITKLGVRIIKYDNFVNTETGSESKEPEKDFCGGKGISPNAGRTKGRSARRNLQRYKLRRANLIEYLKKCGLITDSAVLCENGNRTTFQTYRLRAMAVTEEISLEELSRVFLMINKKRGYKSSRKVKLPDEGQLIDGMAVAEQLYENDLTPGQFVFSILQQGKKSIPEFYRSDLQNELNRIWDHQKQFYPEILTDEFRKQIEGEGRPNTAKMFLGKYKIYTADIKGKDKRLQAYQWRSNALTSQLSIDEVAFVVSELNGAINNASSYLGAIGDRSKELRFNKLTVGQYLMKQLDKDPNYSLKNQVFYRQDYLDEFEAIWEKQAQYHPELTPELKKDIRDIIIFYQRPLKSQKGLVSFCEFESRQIEVNVDGKQKLRTIGCKVCPKSSPLFQEFKIWHTLHSLIVKEKKTNAERFLYQEEKETLFAELNIKETLSKLDALKLLYKNYKDLDLNYDKIEGNRTQAALFKAYQTIISMTGHGEYDFSKMMSDEVMEIVEGVFSGLGYNTNILHFDAENELFDKQPMYMLWHLLYSYEGDKSSTGNKSLIDKIFKLCGFEKEYASIIANIIFQPDYGSLSTKAIRKILPRMKEGNEYSLACEYAGYRHSQRSLTKDELDNKVYKDHLDLLPRNSLRNPVVEKILNQMINVVNFVVDAYGKPDEIRIELARELKKSSKERKEMTMAINKTTADHEKYRQILQKEFGLTNVTRNDIIRYKLYLELKSNGYKTLYSNTYIPQEKLFSKEFDIEHIIPKAKLFDDSFSNKTLESRRVNIEKSNLTAYDYVLGVYDEKGINDYEIRIENLYKSGIISKAKRDKLMMKEVDIPSGFIERDLRDSQYIAKKAREILEELVKFVVPTTGTITDRLREDWQLIDVMQELNWEKYDKLGLTEIVKDKDGREIRRIKDWTKRNDHRHHAMDALTVAFTKRSYIQYLNNLNARSDKSGSIYAIEQKELYRDKHGKLRFNPPMPLDVFRAEAKRQLENTLISIKARNKVLTQNVNITKTKKTESGYRKKVQLTPRGQLHNETFYGAIKWYVPKLESVGSGFNVEQIALVANKRYREALLTRLAACGNDPKKAFTGKNSLEKNPLYLDELHTQQVPTKVKTVTLETVYTTRKDISSDLKIEKVIDRKVRSILKERLKEFGGDPKKAFSNLDANPIWLNKEKGISIKRVTITAVSKAEPLHAKRDHFGKYILDANGAKQPVDYVNTGNNHHVAIYRDEKGVLQERVVSFYEATASASVGLPVVDKEYRKSEGWTFLFSMKQNEYFVFPNEKNGFNPNEIDLMDPDNYALISPNLFRVQKITSKDYVFRHHLETTVEDRKELQNITWKRFQSLTNLDKLVKVRVNHIGQIVSVGEY

SEQ ID NO: 7854 - protein, 1390 aa, unidentified
  REGION 1..1390: note = Description of Unknown:uncultivated organism sequence
MKKILGLDLGTTSIGWALVNEKENDNEQSAIIKLGIRVNPLSVDEQSNFEKGKAITTNADRTLKRSSRRNLQRFKLRRENLLTLLKEHGFITDETVLCEQGNRTTFETRRLRARAVTEEITLEELARVLLMINKKRGYKSSRKADSGEDGKLIDGMTVARQLYDEHLTPGQYVLNLLRKGKKYLPDFYPSDLTAELKAVWRTQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQLQLLEQNPNTSLKNQVFYRQDYLDEFERIWETQASYHPELTTELKHEVRDIVIFYQRQLKSQKGLVGYCELENDTKEVVVDGKKKTVTIGLRVCPKSSPLFQCFKIWQTINNVQVSGNIIPEKQLDLFGTVATYKYGSRCLTEEEKQTLYKELSLKERMKATEILKLLFKNAKGLSLNFHEVDGNRTMAAFVKACQTIIAISGHNEYDFAKLSHETTVSTITQIFNVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYRHSRRSLTKEELDKKPLVDSLPLLPRNSLRNPVVEKILNQMINVVNGVSAQYGKPDEIRIEMARELKKSAKEREQMTADIARATAQQEEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKRDKLLMKEANIPEGFINRDLRDSQYIARKAREILESMVRVVVPTTGAVTDRLREDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQDILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHIQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPIVDRDYKKAEGWQFLFTMKRNEYFVFPNEKTGFNPKEIDLLDPKNYAVISANLFRVQKLSTKYYCFRHHLETNVEEEKLLFDITWKRITSLNKLQGIVKVRVNNIGQIVAIGEY

SEQ ID NO: 7855 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCKGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNISLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDFFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFECQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVDKVVDQRVRKLLQERLAEYGGDAKKAFANLDENPIWLNRERGIAIKRVTIYGVSNATALHDKRDMHGKKMLNSNGMSIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLGLKGIVGIVKVRVNHLGEIVAVGEY

SEQ ID NO: 7856 - protein, 1390 aa, unidentified
  REGION 1..1390: note = Description of Unknown:uncultivated organism sequence
MKKILGLDLGTTSIGWALVNEKENDNEQSAIIKLGVRVNPLSVDEQSNFEKGKAITTNADRTLKRSSRRNLQRFKLRRENLLTLLKEHGFITNETILCEQGNRTTFETRRLRARAVTEEITLEELARVLLMINKKRGYKSSRKADSGEDGKLIDGMTVARQLYDEHLTPGQYVLNLLHKGKKYLPDFYPSDLTAELKAVWRAQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQLQLLEQNPNTSLKNQVFYRQDYLDEFERIWETQASYHPELTTEMKHEVRDIVIFYQRQLKSQKGLVGYCELENDTKEVVVDGKKKTVTIGLRVCPKSSPLFQCFKIWQTINNVQVSGNIIPEKQLDLFGTTATYKYGSRCLTEEEKQTLYKELSLKERMKATEILKLLFKNAKGLSLNFHEVDGNRTMAAFVKACQTIISMSGHNEYDFAKLSHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYRHSRRSLTKEELDKKPLVDSLPLLPRNSLRNPVVEKILNQMINVVNGVSAQYGKPDEIRIEMARELKKSAKEREQMTADIARATAQQEEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKHDKLLMKEANIPEGFINRDLRDSQYIARKAREILESMVRVVVPTTGAVTDRLREDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQDILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPIIDRDYKKAEGWQFLFTMKRNEYFVFPNEKTGFNPKEIDLLDPKNYAVISANLFRVQKLATKDYFFRHHLETSVKEEKLLFDITWKRCRSPKELQGTIKVRVNNIGQIVAIGEY

SEQ ID NO: 7857 - protein, 1390 aa, unidentified
  REGION 1..1390: note = Description of Unknown:uncultivated organism sequence
MKKILGLDLGTTSIGWALVNEKENDNEQSAIIKLGVRVNPLSVDEQSNFEKGKAITTNADRTLKRSSRRNLQRFKLRRENLLTLLKEHGFITDETVLCEQGNRTTFETRRLRARAVTEEITLEELARVLLMINKKRGYKSSRKADSGEDGKLIDGMTVARQLYDEHLTPGQYVLNLLRKGKKYLPDFYPSDLTAELKAVWRTQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQMQLLEQNPNTSLKNQVFYRQDYLDEFERIWETQASYHPELTTELKHEVRDIVIFYQRQLKSQKGLVGYCELENDTKEVVVDGKKKTVTIGLRVCPKSSPLFQCFKIWQTINNVQVSGNIIPEKQLDLFGTVATYKYGSRCLTEEEKQTLYKELSLKERMKATEILKLLFKNAKGLSLNFHEVDGNRTMAAFVKACQTIISMSGHNEYDFAKLSHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYRHSRRSLTKEELDKKPLVDSLPLLPRNSLRNPVVEKILNQMINVVNGVSAQYGKPDEIRIEMARELKKSAKEREQMTADIARATAQQEEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKRDKLLMKEANIPEGFINRDLRDSQYIARKAREILESMVRVVVPTTGAVTDRLREDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQDILVSTKAKNKVVTRNINTIKCKGEKKKTVQLTPRGQLHNETVYGSMRCCVVKEEKIGSTFTEEIIATVASPRYREALLKRLAEYGGNAKKAFTGRNSMEKNPIYLNDDHTLCVPGKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPVVDRDYKKAEGWQFLFTMKRNEYFVFPNEKTGFNPKEIDLLDPKNYAVISANLFRVQKLATKNYFFRHHLETNVETPKELSGITYKSQLGLKGIIGIVKVRVNNIGQIVAIGEY

SEQ ID NO: 7858 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEISLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7859 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTKKRSARRNLQRFKLRRENLLTLLKEHGFITDETVLCEQGNRTTFETRQLRARAVTEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGNCELESKPKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQGILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKKILEARLKEFGGDAKKAFSNLDENPIWLNRERGIQIKRVTIRGVSNAVALRDKHDVQGKPMCDSEGRRMPSDYVSTSGNHHVAIFRDANGNLQEHVVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7860 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7861 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEQSNFEKGKVITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKFWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFERQTAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKRSAKEREKMTRDIARATAENEKYRKILQEKFNKQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVEKVVDQRVRKLLQERLAEYGGDAKKAFANLDENPIWLNRERGIAIKRVTIYGVSNATALHDKRDMHGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7862 - protein, 1385 aa, unidentified
  REGION 1..1385: note = Description of Unknown:uncultivated organism sequence
MGTTSIGWALVNEGENDNEKSSIVKLGVRVNPLSSDEKNEFETGKALTTNAERTNKHGMRINLQRYKQRRANLVRCLKENGIIDDETLLFEHGNSSTFQTYRARAKAVDEEISLADFSRVLLMINKKRGYKSNRKAKDTDDGELIDGMTVAKELHSKGLTPGQFLMMRQKEGKKFRQEFYRSDLQNELDRIWDNQKTFYPDVLTDDMKSEIARVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNASLRNITFYRQDYIDEFNAIWQCQSKYHEELTPALKDEIEKHIIFYQRDLKSCKSLVNHCEFEQSEKEIAVDGKKRKITIGLRACPKSSPLFQTFRTWQKLNDIMVSPSDGKHKSSAMNSVPGLFNDLKTWRPERFLKQEEKEKLFEELSVKGKLTKKEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGVGYSAACEEAGYKHSPRSLTKEELKAKVYAGKMDVVKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGGNKKEQLTPRGKLHNETVYGKIARYQTEMKRVGGSFTEDVVMSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDIAGRLMLDEDGKPVGNDYVNTSNNHHVAIFTDSEGNLQEHVVSFYEATAMAILGYPVVDRQYNKGLGWKFLFSMKQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7863 - protein, 1390 aa, unidentified
  REGION 1..1390: note = Description of Unknown:uncultivated organism sequence
MKKILGLDLGTTSIGWALVNEKENDNEQSAIIKLGVRVNPLSVDEQSNFEKGKAITTNADRTLKRSSRRNLQRFKLRRENLLTLLKEHGFITNETILCEQGNRTTFETRRLRARAVTEEITLEELARVLLMINKKRGYKSSRKADSGEDGKLIDGMTVARQLYDEHLTPGQYVLNLLRKGKKYLPDFYPSDLTAELKAVWRTQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQMQLLEQNPNTSLKHQVFYRQDYLDEFERIWETQASYHPELTTELKHEVRDIVIFYQRQLKSQKGLVGYCELENDTKEVVVNGKKKTVTIGLRVCPKSSPLFQCFKIWQTINNVQVSGNIIPEKQLDLFGTVATYKYGSRCLTEEEKQTLYKELSLKERMKATEILKLLFKNAKGLSLNFHEVEGNRTMAAFVKACQTIISMSGHNEYDFAKLPHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYRHSRRSLTKEELDKKPLVDSLPLLPRNSLRNPVVEKILNQMINVVNGVSAQYGKPDEIRIEMARELKKSAKEREQMTADIARATAHQEEYRRILQDQFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGAISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQDILVSTKAKNKVVTRNINTIKCKGEKKKSVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPIVDRDYKKAEGWQFLFTMKRNEYFVFPNEKTGFNPKEIDLLDPKNYAVISANLFRVQKLATKDYFFRHHLETSVKEEKLLFDITWKRITSLNKLQGIVKVRVNNIGQIVAIGEY

SEQ ID NO: 7864 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTKKRSARRNLQRFKLRRENLLTLLKEHGFITDETVLCEQGNRTTFETRQLRARAVTEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPLPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKEILEARLKEFGGDTKKAFSNLDENPIWLNRERGIQIKRVTIRGVSNAVALHDKHDVQGKPMCDSEGRRMPSDYVSTSSNHHMAIFRDANGNLQEHVVSYFEATARAIQHLPIVDRDYNKDEGWQFLFTMKRNEYFVFPNEKTGFDPKEVDLLDSKNYAVISDNLFRVQKLATKDYFFRHHLETSVENNKSLCDITWKRITSLNKLQGIVKVRVNNIGQIVAVGEY

SEQ ID NO: 7865 - protein, 1386 aa, unidentified
  REGION 1..1386: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVTEEITLEELARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAGQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKNLVGYCELESKQKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKCRGEKKQTVQLTPRCQLHNETVYGSMRCCVVKEEKISSSFTEEKIATVASPRYREALLKRLGEYGGNAKKAFTGRNSLEKNPLYLNDDHTLSVPAKVKTVTYETIFTQRKPIDKDLKVDKHVKEILEARLKEFGGDAKKAFSNLDENPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 7866 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWKTQARFHKELTPERLHIIRDIIIFFQRDLKSQKSNIAICEFENQKREITVDGKKKIIEYGPKVCPKSSPIFQEFKIWQTINNLKISNIYGEELSLSSDERQILFEELSIRKKLTCAEILKLLHKDSKCSLNYKEIQGNTTISAIFDAFKEIILQSGHDNNNFNKASFKDTMLIIEPIFKMLRINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTNRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7867 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSRSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRRAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETKVDDNNALKGTTWIRIRSLPALENIIKVRVNNIGQIVAVGEY

SEQ ID NO: 7868 - protein, 537 aa, unidentified
  REGION 1..537: note = Description of Unknown:uncultivated organism sequence
MTTAEIPDGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLKDVFVSIKAKNKVVTRNVNITRGADGKKHRTVQLTPRGQLHNETVYGSRRRYVVKQEKVSSAFNEEKISTIGNPQIREALLRRLAEFGGDAKKAFTGKNSLEKNSIYLDDSHTKQVPQKVKTVTLEEVFTIRKPIDKDLNVEKVVDHRVRKLLQERLAEYGGDAKKAFANLDENPIWLNRERGIAIKRVTIYGVSNATALHDKRDMHGKKMLDSNGISIPIDYVSTSNNHHVAIFRDKDGNLQEHIVSFFEATERAQQQLPIVDYEYNKHLGWQFLFTMKRNEYFVFPNEKTGFDPNEVDLLDPNNAAEISKNLFRVQKLTTKDYFFRHHLETNVETPKELLGTTYARLSLKGIVGIVKVRVNHLGEIVAVGEY

SEQ ID NO: 7869 - protein, 1092 aa, unidentified
  REGION 1..1092: note = Description of Unknown:uncultivated organism sequence
MKKILGLDLGTTSIGWALVNEKENDNEQSSIIKLGVRVNPLSVDEQSNFEKGKAITTNADRTKKRSARRNLQRFKLRRENLLTLLKEHGFITDETVLCEQGNRTTFETRQLRARAVTEEITLEQLARVLLMINKKRGYKSSRKADSGEDGKLIDGMSVARQLYEQHLTPGQYVLNLLRKGKKYLPDFYPSDLTAELKAVWHAQQAYYPELLTQDLFDALKNKNEKQTWAICAQQFGINGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVKVSGNIIPEKQLDLFGTVATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHDYAAVFAAITFMPDYGNLSAKAMRRILPYMMDGNEYSVACEYAGYRHSRRSLTKEELDKKPLVDTLSLLPRNSLRNPVVEKILNQMINVVNEVSAQYGKPDEIRIEMARELKKSAKEREQMTADITRATAQQEKYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPESFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPLPLDVFRAEARRQLQDILVSTKAKNKVVTRNINSIKRRGEKKQTVQLTPRCQLHNETVYGSMRCCVVKEEKISSSFTEEKNCYRGESSLS

SEQ ID NO: 7870 - protein, 907 aa, unidentified
  REGION 1..907: note = Description of Unknown:uncultivated organism sequence
MNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7871 - protein, 1398 aa, unidentified
  REGION 1..1398: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNCTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNRTMAAFVKACQTIIVMSGHNEYDFAKLSYETIVSTINQIFNALGIKSGFLNFDPCLEGKAFEHQPAYQLWHLLYSYAGDNSATGNEKLITRIAETFGMEHNYAAVFAAITFMPNYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTKHSFIQYLNNLNARSNKSGSIYAIEQICLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGDAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSSNHHVAIFRDANGNLQEHIVSYFEATARAIQHLPIVDRNYSKDEGWQFLFTMKRNEYFVFPNEKTGFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 7872 - protein, 1394 aa, unidentified
  REGION 1..1394: note = Description of Unknown:uncultivated organism sequence
MKHILGLDLGTNSIGWALVKERENENEQYSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVVSLLRKGKNNIPDFYRSDLVAEFDKIWNFQRQFYPDVLTDSLKEELKGKGDKETWAICSKPFAIEGIKRNIKGWEQKKEDYAWRAESLQHKIDLERLAIVLQKVNGQIKNSSGYLGAISDRSKELFFNKLTVGQYQMAELDKNPNFSLKNQVFYRQDYLDEFERIWETQSKFHKELTPELKHFIRDIIIFYQRPLKSQKGLISLCELESREIEIERDGKKTKKTIGPRVCPKSSPMYQEFRIWQAINNLQVSGMVVADNQVDLFGKTIGKKFGKRFLEQEEKEILFKELNFKSKLTKKEILKLLFENYKELDLNYNEVKGNTTMAALLEACSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLPRNSLRNPVVEKILNQMINVVNAVVDTYGRPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYGGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVIWKRIKSLGKIKDIVKVRINQIGKIEDLGEY

SEQ ID NO: 7873 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCKGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNISLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFECQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVDKVVDQRVRKLLQERLAEYGGDAKKAFANLDENPIWLNRERGIAIKRVTIYGVSNATALHDKRDMHGKKMLNSNGMSIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLGLKGIVGIVKVRVNHLGEIVAVGEY

SEQ ID NO: 7874 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIKLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7875 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNSTISAIFDAFKEIILQSGHDNNNFNKASFKDTMLIIEPIFKMLGINTDILSLDCPTDSPSLKTCPIYQLWHLLYSYVGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLRNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNITEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7876 - protein, 1385 aa, unidentified
  REGION 1..1385: note = Description of Unknown:uncultivated organism sequence
MGTTSIGWALVNEGENYNEKSSIVKLGVRVNPLSSDEKNEFETGKALTTNAERTNKHGMRINLQRYKQRRANLVRCLKENGIIDDETLLFEHGNSSTFQTYRARAKAVDEEISLADFSRVLLMINKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNASLRNITFYRQDYIDEFNAIWQCQSKYHEELTPALKDEIEKHIIFYQRDLKSCKSLVNHCEFEQSEKEIAVDGKKRKITIGLRACPKSSPLFQTFRTWQKLNDIMVSPSDGKNKSSAMNSVPGLFNDLKTWRPERFLKQEEKEKLFEELSVKGKLTKKEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGMGYSAACEEAGYKHSPRSLTKEELKAKVYAGKMDVIKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGLNKKEQLTPRGKLHNETVYGKISRYQTEMKRVGGSFTEDVVLSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDISGRPMLDEDGKPVGNDYVNTSNNHHVAIFTDSEGNLQEHVVSFYEATAMAILGYPVVDRQYNKGLGWKFLFSMKQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7877 - protein, 1402 aa, unidentified
  REGION 1..1402: note = Description of Unknown:uncultivated organism sequence
MKRILGLDLGPNSIGWALVNERENEAEHSSIVKLGSRIINFDGFVSTKTGKESKTPLDDFKQGKGISSCAGRTLKRTMRRNLQRYKLRRDSLVGILKSNGLISNDAVLAECGNRTTFETYRLRASAATEEITLEELARVLLMINKKRGYKSSRKAKQKDEDGHLIDGMEVARRLYDDGLTPGQYTLSLMEKGNRHIPDFYRSDLQAELNKVWDCQRRFYPDILTDELKDAIQGKNKSQTRAVCSTPFGIKGMKRNTKGEQMRKENYRWRVEALTDKLDLERLAVVLQEINGQLKNSSGYLGAISDRSKELYFNHQTVGQHLMAELDRNPNYSLKNKVYYRQDYLDEFERIWETQAKYHKELTPELKHEIRDVVIFYQRPLKSQKGLISHCEFESREIEIEVDGHKKKITAGLRVCPKSSPLYQEFRIWQMINNVQVSGPIEPENQPDLFGATAKYRKGKRFLTQEEKETLASELTFRDKMTKKEILKLLFDNPKELDLNYKEIKGNTTMAALMKVCLGIVDMSGHGEYDVSKISVSDAIGVIVSVFNALGFSSAFLDFDSSLDGKDFAAQSAYRLWHLLYSFEGDKSKTGNERLVAKIQELYGFDKDSAAMIAGITFEPDYGNLSAKAMRKILPYMKDGVEYSEACRMAGYRHSKRSLTKEEIETKQLKDHLDLLPRNSLRNPVVEKILNQMINVVNAAICEYGRPDEIRIEMARELKKSTSEREEMVKAISRATADNEKYRKMLQEEFGMANVSRNDIIRYRLYMELKENGFRTLYSGTYIPREKLFSKEFDIEHIIPQAKLFDDSFANKTLEARNVNLEKSNMTAYDYVKGKYDAAGLEQYEQRVEALYAKGAISKTKRNRLLTVEADIPDGFINRDLNDTQYIARKAREILEEVVRTVTPTTGSVTDRLRDDWQLVDVMKELNWDKYDRLGLTEIVEDKDGRRIRRIKDWTKRNDHRHHAMDALTIAFTKPAYIQYLNNLNARSDRSGSIYAIERKELYRDRGGKLRFMPPMPLDELRREARRQLEAVLVSIKAKNKVVTRNINVTNAKGGGHRKVQLTPRGQLHNETIYGSIRRYATKEEKVNASFTEDKIMTVADKRYREALLERLRLCYGDPKKAFTGRNSLDKNPLFVGRMHTEKVPTKVKTVTLETIFTQRKEVNKDLKVDKVIDTRVRKILEERLRQYGGDAQAAFSNLDENPIWLNKEKGISIKRVTITGVNNAVALHDKRDNLGRLILDGNGNKQPSDYVSTSNNHHVAIFRDAEGNLQEHVVSFYEATARAIQHLPVIDRDYNKAVGWQFLFTMKQNEYFVFPNAETGFDPKEIDLLDPKNYAAISPNLFRVQKVSKKNYMFRHHLETTVEEKKELQGFTWKNIRSLGGIDKLVKVRVNHLGQIVSVGEY

SEQ ID NO: 7878 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRRAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVGIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7879 - protein, 1373 aa, unidentified
  REGION 1..1373: note = Description of Unknown:uncultivated organism sequence
MVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHSELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDEFGMPHVSRNDITRYRLWLELKDNGYKTLYSQTYIPREKLFSKEFDVEHIIPQARLFDDSFSNKTLEARQANLEKSNATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYNKLGLTETFKDHDGRQIKRIKDWTKRNDHRHHAMDALTIAFTQHSFIQYLNNLNARSNKAGSIYAIEQICLYHDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPICDSEGRRMPSDYVSTSSNHHVAIFRDANGNLQEHIVSYFEATARAIQHLPIVDRNYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7880 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7881 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVVSLLRKGKNNIPDFYRSDLVAEFDKIWNFQRQFYPDVLTDSLKEELKGKGDKETWAICSKPFAIEGIKRNIKGWEQKKEDYAWRAESLQHKIDLERLAIVLQKVNGQIKNSSGYLGAISDRSKELFFNKLTVGQYQMAELDKNPNFSLKNQVFYRQDYLDEFERIWETQSKFHKELTPELKHFIRDIIIFYQRPLKSQKGLISLCELESREIEIERDGKKTKKTIGPRVCPKSSPMYQEFRIWQAINNLQVSGMVVADNQVDLFGKTIGKKFGKRFLEQEEKEILFKELNFKSKLTKKEILKLLFENYKELDLNYNEVKGNTTMAALLEACSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLPRNSLRNPVVEKILNQMINVVNAVVDTYGRPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYGGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVIWKRIKSLGKIKDIVKVRINQIGKIEDLGEY

SEQ ID NO: 7882 - protein, 1372 aa, unidentified
  REGION 1..1372: note = Description of Unknown:uncultivated organism sequence
MKRILGLDLGTTSIGWAIVNEAENENETSSIIKLGVRVKPLTVDEQNTFETGKSITTNSDRTLKRSMRRNLQRRKLRRKNLIECLKENDIIENDTILCEEGNKTTFQTYRDRADAAVNEISLEAFARVLLMINKKRGYKSSRKAKSAEEGQLIDGMAVATELYERNLTPGMFVTELLKKGKRYVPDFYRSDLVAEMERIWQFQKQFHADILTDDVRKQLKNKKKQQTENIFLKNFGISSADNKEKDKRRQAFQWRADAVRKELTREELAYVIADVNGAISNSSGYLGAISDRSKELIFNHQTVGQYLMERLNADPHFSLKNQTFYRQDYLDEFETIWETQAKYHKQLTPELKKEIRDIIIFYQRPLKSNKGSIDVCYFENHQKTITEHGKTRTKRVGLKVLPKSSPLFQEFRIWQILHNIVVSETSSGNKRPLYQEEKELLFAELNIKEKLTKNEVLKLLFSKPRSYDLNYEEVEGNHTLAAIYSACQEIISMSGHGEYNFQKLPANDINKVVYGVFSGLGFKTDFLTFDSSLEKHDLEKQPMYRLWHLLYSYEGDNSNTGNRSLIEKIRSITGLDPEYANILANVSLQQKYGSLSAKAVRKILPYMKEGFNYSDACEKAGYRHSDSLTREELEHKEYKNHLDLLPRNSLRNPVVEKILNQMINVVNEIVKVYGRPDEIRIELARELKKSAKEREQMSKDIREGTKRNEELRKEIETKFGIKNVTRNDILRYRLYLELAPNGFKTLYSKTRIPEEKVFSKEFDIEHIIPQARLFDDSFSNKTLEARQINIDKSNKTAIDFIRERYGEDYTEEYKQSVEDLLKSGAISRAKRNKLLMTEADIPSDFIDRDLRNSQYIAKKARAILLNICMFVNPTIGSITDRLREDWQLINVMQELNWDKYDRLGLTETITDHNGKPLRRIKDWTKRNDHRHHAMDALAIAFTRPEFVQYLNNLNARSDKAGVIYAIEKKYLERDKNGKLRFIAPIPLAEFRAEAKRKLEEILISIKAKNKVTTQNVNVIRTREGKIKRTQQTPRGQLHNESIYGHIQRYTTREVKVNGSFDEQMISLVSKKAYREALLSRLHEFDNDPQKAFTGKNSLDKTPIWLDRNHTWAVPLKVKITEMQDEYPIRKDIAPDLKIDKVIDTGVRSILQRRLDEYSGDARKAFSNLDENPIWLNKEAGITIKRVRIKGIANETALRSKKNHKGEFICTADGKKQAVDFVNTGNNHHIAVFRDETGKLQECIVPFLKVTERKAQDLPAIDKDYRKADGWTFEFTMKQNELFVFPNEETGFDPSEIDLLNPDNYALISPNLYRVQKLAAHDYYFRHHLETTVEDKETLKNISFKRIMSLAKLENIVKVRVNHIGQIVEIGEY

SEQ ID NO: 7883 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7884 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKEIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7885 - protein, 1385 aa, unidentified
  REGION 1..1385: note = Description of Unknown:uncultivated organism sequence
MGTTSIGWALVNEGENDNEKSSIVKLGVRVNPLSSDEKNEFETGKALTTNAERTNKHGMRINLQRYKQRRANLVRCLKENGIIDDETLLFEHGNSSTFQTYRARAKAVDEEISLADFSRVLLMVNKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNASLRNITFYRQDYIDEFNAIWQCQSKYHKELTPALKDEIEKHIIFYQRDLKSCKSLVNHCEFEQSEKEIAVDGKKRKITIGLRACPKSSPLFQTFRTWQKLNDIMVSPSDGKNKSSAMNSVPGLFNDLKTWKPERFLKHEEKEKLFEELSVKGKLTKNEALCILFGKANGLEMNFREVEGNQTMAAIYGACRDIISQSGNGEYDFRKMSAAEIKSTVSEIFGKLGYDTSFLDFDPLSEGKALERQSSYRLWHLLYSYAGDKSVTGNDALLERIGELCGLDRESAGIMAKVSFAEDYGKLSAKAMRKILRYMMKGMGYSAACEEAGYKHSPRSLTKEELKAKLYAGKMDVVKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVVMKHDEKYLVDYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGVNKKEQLTPRGKLHNETVYGKISRYQTEMKRVGGSFTEDVVLSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDIAGRPMLDEDGKPVGNDYVNTSNNHHVAIFTDSEGNLQEHVVSFYEATAMAILGYPVVDRQYNKGLGWKFLFSMNQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7886 - protein, 1395 aa, unidentified
  REGION 1..1395: note = Description of Unknown:uncultivated organism sequence
MKKILGLDLGTNSIGWALVKERENENEQSSIIRLGVREIYLTTDEQSNFEKGKSITTNADRTQKRSMRRNLQRYKLRRDNLINELKAHGFITADTLLNENGNRTTFETYRLRARAVTEEISLEELARVLLMINKKRGYKSNRKVKSNDESGQLIDGMEVAKKLYDDNITPGQYVASLLRNGKNSIPDFYRSDLVAEFNKIWSFQRLFYPNVLTDSLKEELKGKGDRETWAICSKPFDIVGLKRKTKGWEQKKEDYVWRAESLQHKIDLERLAIVLQKVNGQIKNSSGYLGAISDRSKELFFNKLTVGQYQMAELDKNPNFSLKNQVFYRQDYLDEFERIWETQAKFHKELTPELKHIIRDIVIFYQRPLKSQKGLISLCELESREVEIEKDGKKVKKTIGPRVCPKSSPMYQEFRIWQQINNLQVSGMIVPDNRFDLFGETLDMKFGKRFLEQEEKEILFKELNFKSKLTKKEILRLLFKNYKELDLNYNEVKGNTTMAVLLEAYSKIIEMSGHGEYDFSKMTADEIKDIVFPIFNGLGFNTDILSFDSSVEDKALEKQPSYMFWHLLYSYEGDNSKTGNESLIKKISECYGFDKEYAAVIADIRFEPDYGSLSVKAMRKILPYMKDGLVYSDACQYAGYRHSKRSLTKGEIDARPLKNKLDLLPRNSLRNPIVEKILNQMINVVNAVVDVYGRPDEIRVEMARELKKTKAQREETVKTIRKVTAENEKYKKELEEEFGLKNVSRNDIIRYRLYLELKDNGFKTLYSNTYIPREKLFSKEFDIEHIIPQAKLFDDSLSNKTLEARNVNIEKADSTAYDYVKGKYGDEGLKKYNEKIKQLYEKKIIGKTKFKRLLTTEKDIPDGFINRDLSNTQYIARKACEILEEVARRVVSTTGSVTSRLREDWQLVDIMKELNWDKYDRLGLTEIIEDRDGRRIKHIKNWTKRNDQRHHAMDALTIAFTKPVFIQYLNNLNARSDKGGSIYAIERKELYRDNKGKLRFYPPMPLDDFRAEAKCHLENILVSIKAKNKVVTRNVNITRTEKAEKGKHERIQLTPRGKLHNETIYGSIKRYDGNKEKVNASFDVSKIMTVADKRYREALLRRLEQFEGDARKAFTGKNSLEKNPLFVDELHTKKVPDIVKTVKFGTIYTQRKEISDELKIDKVIDNKVRKILEERLAEFNGDAKKAFSNLDENPIWLNKEKGISIKRVTINSGLKDPTALHDKRDNNGRLILYKDGKKQPTDFVSTSNNHHVAIFCDIEGQIQEHLVSFYEATARAIQHLPVVDRNFNKDKDWQFMFTMKQNEYFVFPNKETGFDPKEIDLLNPKNYAAISPNLYRVQKLSSKYYVFRHHLETTVDDKKELLGITWKRIRSLDNLRDIVKVRINHLGQIVNVGEY

SEQ ID NO: 7887 - protein, 902 aa, unidentified
  REGION 1..902: note = Description of Unknown:uncultivated organism sequence
MAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAVVFAAITFMPDYGNLSAKAMRRILPYMMDGNEYSVACEYAGYRHSRRSLTKEELDKKPLVDTLPLLPRNSLRNPVVEKILNQMINVVNKLSAQYGKPDEIRIEMARELKKSAKEREQMTADITRATAQQEEYRRILQDEFGMPHVSRNDIIRYRLWLELKDNGYKTLYSQTYIPREKLFSKEFDVEHIIPQARLFDDSFSNKTLEARQANLEKSNATAFDYVQSKYGEEGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRQLQDILVSTKAKNKVVTRNINSIKRRGEKKQTVQLTPRCQLHNETVYGSMRCCVVKEEKISSSFTEEKIATVASPRYREALLKRLGEYGGNAKKAFTGRNSLEKNPLYLNDDHTLSMPAKVKTVTYETIFTQRKPIDKDLKVDKVIDEHVKEILEARLKEFGGDAKKAFSNLDENPIWLNRERGIQIKRVTIRGVSNAVALHDKHDVQGKPMCDSEGRRMPSDYVSTSSNHHVAIFRDANGNLQEHVVSYFEATARAIQHLPIVDRDYNKDEGWQFLFTMKRNEYFVFPNEKTGFDPKEVDLLDPKNYAEISENLFRVQTMSKLQYGNSFVRDYKFRHHLETTLNDNKELRDITYKQFKSLNFADTIVKVRVNNIGQIVAVGEY

SEQ ID NO: 7888 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERRHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7889 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLVHGMRLNLSRYKQRRKELIKNLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFEEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETNVDDNNALKGTTWIRITSLKALENVIKVRVNNIGQIVAVGEY

SEQ ID NO: 7890 - protein, 1393 aa, unidentified
  REGION 1..1393: note = Description of Unknown:uncultivated organism sequence
MENVKHTSMKKILGLDLGTNSTGWALVNEAENTAEKSSITKLGVRIIKYDNFVNTETGSESKEPEKDFCGGKGISPNAGRTKGRSARRNLQRYKLRRANLIEYLKKCGLITDSAVLCENGNRTTFQTYRLRAMAVTEEISLEELSRVFLMINKKRGYKSSRKAKLPDEGQLIDGMAVAEQLYENDLTPGQFVFSILQQGKKSIPEFYRSDLQNELNRIWDHQKQFYPEILTDEFRKQIEGEGRPNTAKMFLGKYKIYTADIKGKDKRLQAYQWRSNALTSQLSIDEVAFVVSELNGAINNASSYLGAIGDRSKELRFNKLTVGQYLMKQLDKDPNYSLKNQVFYRQDYLDEFEAIWEKQAQYHPELTPELKKDIRDIIIFYQRPLKSQKGLVSFCEFESRQIEVNVDGKQKLRTIGCKVCPKSSPLFQEFKIWHTLHSLIVKEKKTNAERFLYQEEKETLFAELNIKETLSKLDALKLLYKNYKDLDLNYDKIEGNRTQAALFKAYQTIISMTGHGEYDFSKMMSDEVMEIVEGVFSGLGYNTDILHFDAENELFDKQPMYMLWHLLYSYEGDKSSTGNKSLIDKIFKLCGFEKEYASIIANIIFQSDYGSLSTKAIRKILPRMKEGNEYSLACEYAGYRHSQRSLTKDELDNKVYKDHLDLLPRNSLRNPVVEKILNQMINVVNFVVDAYGKPDEIRIELARELKKSSKERKEMTMAINKTTADHEKYRQILQKEFGLTNVTRNDIIRYKLYLELKSNGYKTLYSNTYIPQEKLFSKEFDIEHIIPKTKLFDDSFSNKTLESRRVNIEKSNLTAYDYVLGVYDEKGINDYEIRIENLYKSGIISKAKRDKLMMKEVDIPSGFIERDLRDSQYIAKKAREILEELVRFVVPTTGTITDRLREDWQLIDVMQELNWEKYDKLGLTEIVKDKDGRQIRRIKDWTKRNDHRHHAMDALTVAFTKRSYIQYLNNLNAKSDKSGSIYAIEQKELYRDKHGKLRFNPPMPLDVFRAEAKRQLENTLISIKARNKVVTQNVNITKTKKTESGYRKKIQLTPRGQLHNETFYGAIKRYVTKLESVGSGFNVEQIALVANKRYREALLTRLAACGNDPKKAFTGKNSLEKNPLYLDELHTQQVPTKVKTVTLETVYTTRKDISSDLKIEKVIDRKVRSILKERLKKFGGDPKKAFSNLDANPIWLNKEKGISIKRVTITAVSKAEPLHAKRDHFGKYILDANGAKQPVDYVNTGNNHHVAIYRDEKGVLQERVVSFYEATASASVGLPVVDKEYRKSEGWTFLFSMKQNEYFVFPNEKNGFNPNEIDLMDPDNYALISPNLFRVQKIASKDYVFRHHLETTVEDRKELQNITWKRFQSLTNLDKLVKVRVNHIGQIVSVGEY

SEQ ID NO: 7891 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNDIGQIVAVGEY

SEQ ID NO: 7892 - protein, 1395 aa, unidentified
  REGION 1..1395: note = Description of Unknown:uncultivated organism sequence
MKKILGLDLGTNSIGWALVKERENENEQSSIIRLGVREIYLTTDEQSNFEKGKSITTNADRTQKRSMRRNLQRYKIRRDSLINVLKDHGFITADTLLNENGNRTTFETYRLRARAVTEEISLEEFARVLLMINKKRGYKSSRKVKSNDESGQLIDGMEVAKKLYDDNLTPGQYVALLLHNGKNSIPDFYRSDLVDEFNKIWNFQRLFYPNVLTDNLKEELKGKGDKETWAICSKPFDIVGLKRKTKGWEQKKEDYVWRAESLHHKIDLERLAIVLQKVNGQIKNSSGYLGAISDRSKELFFYKLTVGQYQMSELDKNPNFSLKNQVFYRQDYLDEFECIWETQAKFHKELTPELKHIIRDIVIFYQRPLKSQKGLISLCELESREIEIEKNGKKVKKTIGPRVCPKSSPMYQEFRIWQTINNLQVSGMIVADNRFDLFGETVGMKFGKRFLEQEEKEILFKELNFKSKLAKKEILRLLFKNYKELDLNYNEVKGNTTMAALLEACSKIIEMSGHGEYDFSKMTADEIKDFVFPIFNGLGFNTDILSFDSSVEGKAFEKQPSYMFWHLLYSYEGDKSKTGNESLINKISECYGFDKEYAAVIAGIRLEPDYGNLSVKAMRKILPYMKDGLGYSDACQYAGYRHSKRSLTKEEIDSRPLKNKVDLLPRNSLRNPIVEKILNQMINVVNAVVDVYGRPDEIRVEMARELKKTKAQREETVKTIRKVTVENEKYKKELEEEFGLKNVSRNDIIRYRLYLELKDNGFKTLYSNTYIPREKLFSKEFDIEHIIPQAKLFDDSLSNKTLEARNVNIEKADSTAYDYVKAKYGDEGLKKYNEKVKQLYEKKIIGKTKFKRLLTTEKDIPDGFINRDLSNTQYIARKACEILEEVARRVVSTTGSVTSRLREDWQLVDIMKELNWDKYDRLGLTEIVEDRDGRRIKHIKDWTKRNDQRHHAMDALTIAFTKPAFIQYLNNLNARSDKGGSIYTIERKELYRDNKGKLRLYPPMPLDEFRAEAKCHLENILVSIKAKNKVVTRNVNITRTEKAEKGKHERIQLTPRGKLHNETIYGSIKRYDGNKEKVNASFDVSKIMTVADKRYREALLRRLEQFEGDARKAFTGKNSLEKNPLFVDELHTKKVPDIVKTVKFGTIYTQRKEISDELKIDKVIDNKVRKILEERLAEFNGDAKKAFSNLDENPIWLNKEKGISIKRVTINSGLKDPTALHDKRDNNGRLILDKDGKKQPTDFVSTSNNHHVAIFCDIEGQIQEHLVSFYEATARAIQHLPVVDRNFNKDKDWQFMFTMKQNEYFVFPNKETGFDPKEIDLLNPKNYAAISPNLYRVQKLSSKYYVFRHHLETTVDDKKELLGITWKRIRSLDNLRDIVKVRINHLGQIVNVGEY

SEQ ID NO: 7893 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLGKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNKFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVSFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7894 - protein, 1111 aa, unidentified
  REGION 1..1111: note = Description of Unknown:uncultivated organism sequence
MKLIFGFDLGSTSIGWAVVQEKENDTETSRILKLGVRVNPLTTDEKTDFEKGKPITTNANRRLAHGMRLNLSRYKQRRKELIKNLIRFKFISPDTVLCENGSNTTFETLRLRAKATTEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGCPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQKREITVDGKKKIIEFGPKVCPKSSPIFQEFKIWQTINNLKISNIYGEELSLSADERQILFEELSIRKKLTCAEILKLLHKDSKCSLNYKEIQGNTTISAIFDALKEIILQSGHDNNNLNKASFKDTMLIIEPIFKMLGINTDILSLDCPTDSPSLKTCPIYQLWHLLYSYTGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVGLTPRGQLFNETTYGCVKQYETKLESVNSSFDTDKIMTVADKSYRQALMKRIEEFDAMPLWLSLEKTQSQRIRYTLTIPILTLSLSK

SEQ ID NO: 7895 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGTNTTFETLRLRAKAATEEITLEELSRVLLMINKKRGYKSNRKAQPNDNGAIDNIDIAKKLYQSYLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQEREITVDGKKKIIEFGPKVCPKSSPIFQEFKIWQTINNLKISNIYGEELSLSSDERQILFEELSIRKKLTCAEILKLLHKDSKCSLNYKEIQGNATISVIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7896 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQDLFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPNTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNHTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFAAITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILLDEFGMPHVSRNDITRYRLWLELKDNGYKTLYSQTYIPREKLFSKEFDVEHIIPQARLFDDSFSNKTLEARQANLEKSDATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTQHSFIQYLNNLNARSNKAGSIYAIEQTCLYRDAHGKLRFMPPMPLDVFRAEARRLLQDILVSTKAKNKVVTRNINSIKRRGEKKQTVQLTPRCQLHNETVYGSVRCCVVKEEKISSSFTEEKIATVASPRYREALLKRLGENDGNAKKAFTGRNSLEKNPLYLNDDHTLSVPAKVKTVTYETIFTQRKPIDKDLKVDKVIDEHVKEILEARLKEFGGDAKKAFSNLDENPIWLNRERGIQIKRVTIRGVSNAVALHDKHDVQGKPICDSEGRRMPSDYVSTSSNHHVAIFRDANGNLQEHIVSYFEATARAIQHLPIVDRDYKKAEGWQFLFTMKRNEYFVFPNEKTGFDPKEIDLLDPKNYAEISANLFRVQKLATKDFFFRHHLETSVKEEKLLFDITWKRCRSLKELQGIVKVRINNIGQIVAVGEY

SEQ ID NO: 7897 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLVHGMRLNLSRYKQRRKELIKNLIRFKFISPDTVLCENGSNTTFETLRLRAKAATEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMHIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNDIGQIVAVGEY

SEQ ID NO: 7898 - protein, 1048 aa, unidentified
  REGION 1..1048: note = Description of Unknown:uncultivated organism sequence
MKKILGLDLGTNSIGWALVKERENENEQSSIIRLGVREIYLTTDEQSNFEKGKSITTNADRTQKRSMRRNLQRYKIRRDSLINVLKDHGFITADTLLNENGNRTTFETYRLRARAVTEEISLEEFARVLLMINKKRGYKSSRKVKSNDESGQLIDGMEVAKKLYDDNLTPGQYVALLLHNGKNSIPDFYRSDLVDEFNKIWNFQRLFYPNVLTDNLKEELKGKGDKETWAICSKPFDIVGLKRKTKGWEQKKEDYVWRAESLHHKIDLERLAIVLQKVNGQIKNSSGYLGAISDRSKELFFNKLTVGQYQMSELDKNPNFSLKNQVFYRQDYLDEFEFIWETQAKFHKELTPELKHIIRDIVIFYQRPLKSQKGLISLCELESREIEIEKNGKKVKKTIGPRVCPKSSPMYQEFRIWQTINNLQVSGMIVADNRFDLFGETVGMKFGKRFLEQEEKEILFKELNFKSKLAKKEILRLLFKNYKELDLNYNEVKGNTTMAALLEACSKIIEMSGHGEYDFSKMTADEIKDFVFPIFNGLGFNTDILSFDSSVEGKAFEKQPSYMFWHLLYSYEGDKSKTGNESLINKISECYGFDKEYAAVIAGIRLEPDYGNLSVKAMRKILPYMKDGLGYSDACQYAGYRHSKRSLTKEEIDSRPLKNKMDLLPRNSLRNPIVEKILNQMINVVNAVVDVYGRPDEIRVEMARELKKTKAQREETVKTIRKVTVENEKYKKELEEEFGLKNVSRNDIIRYRLYLELKDNGFKTLYSNTYIPREKLFSKEFDIEHIIPQAKLFDDSLSNKTLEARNVNIEKADSTAYDYVKAKYGDEGLKKYNEKVKQLYEKKIIGKTKFKRLLTTEKDIPDGFINRDLSNTQYIARKACEILEEVARRVVSTTGSVTSRLREDWQLVDIMKELNWDKYDRLGLTEIVEDRDGRRIKHIKDWTKRNDQRHHAMDALTIAFTKPAFIQYLNNLNARSDKGGSIYTIERKELYRDNKGKLRFYPPMPLDEFRAEAKCHLENILVSIKAKNKVVTRNVNITRTGKSRERKT

SEQ ID NO: 7899 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPREYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7900 - protein, 1393 aa, unidentified
  REGION 1..1393: note = Description of Unknown:uncultivated organism sequence
MKRILGLDLGTTSIGWALVNEGENYNEKSSIVKLGVRVNPLSSDEKNEFETGKALTTNAERTNKHGMRINLQRYKQRRANLVRCLKENGIIDDETLLFEHGNSSTFQTYRARAKAVDEEISLADFSRVLLMINKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNASLRNITFYRQDYIDEFNAIWQCQSKYHEELTPALKDEIEKHIIFYQRDLKSCKSLVNHCEFEQSEKEIAVDGKKRKITIGLRACPKSSPLFQTFRTWQKLNDIMVSPSDGKNKSSAMNSVPGLFNDLKTWRPERFLKQEEKEKLFEELSVKGKLTKKEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGMGYSAACEEAGYKHSPRSLTKEELKAKVYAGKMDVIKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGLNKKEQLTPRGKLHNETVYGKISRYQTEMKRVGGSFTEDVVLSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDISGRPMLDEDGKPVGNDYVNTSNNHHVAIFTDSEGNLQEHVVSFYEATAMAILGYPVVDRQYNKGLGWKFLFSMKQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7901 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKPITTNADRTQKRSMRRNLQRYKLRRDSLISLLKDYGFITAETLLNENGNRTTFETYRLRAKAVTEEISLEEFARVLLMINKKRGYKSSRKAKSNDESGQLIDGMEVAKKLYDENLTPGQYVASLLRKGKNNIPDFYRSDLVAEFDKIWSFQRQFYPDMLTDSLKEELKGKGDKETWAICSKPFGIVGLKRKTKGWEQKKEDYSWRAESLQHKIDLERLAVVLQKVKGQIKNSSGYLGAISDRSKELFFNRLTVGQYLMAELDKNPNFSLKNQVFYRQDYLDEFERIWDTQAKFHNELTPELKHIIRDIVIFYQRPLKSQKGLISLCELESREIEIERNGKMVKKTIGPRVCPKSSPMYQEFRIWQTINNLQVSGMVVADGQVDLFGEKVGTKFGKRFLEQEEKEILFKELNFKNKMTKREILKLLFENYKELDLNYNEVKGNTTMAALLASCSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLPRNSLRNPVVEKILNQMINVVNAVVDTYGSPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYGGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVIWKRIKSLGKIKDIVKVRINQIGKIEDLGEY

SEQ ID NO: 7902 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLAHGMRLNLSRYKQRRKELIKNLIRFKFISPDTVLCENGSNTTFETLRLRAKAATEEITLEELSRVLLMINKKRGYKSNRKAQPNGNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRTQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQKREITVDGKKKIIEFGPKVCPKSSPIFQEFKIWQTINNLKISNIYGEELSLSADERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7903 - protein, 1400 aa, unidentified
  REGION 1..1400: note = Description of Unknown:uncultivated organism sequence
MKKILGLDLGTNSIGWALVKERENENEQSSIIRLGVREIYLTTDEQSNFEKGKSITTNADRTQKRSMRRNLQRYKLRRDNLINELKAHGFITADTLLNENGNRTTFETYRLRARAVTEEISLEELARVLLMINKKRGYKSNRKVKSNDESGQLIDGMEVAKKLYDDNITPGQYVASLLRNGKNSIPDFYRSDLVAEFNKIWSFQRLFYPNVLTDSLKEELKGKGDKETWAICSKPFDIVGLKRKTKGWEQKKEDYVWRAESLQHKIDLERLAIVLQKVNGQIKNSSGYLGAISDRSKELFFNKLTVGQYQMAELDKNPNFSLKNQVFYRQDYLDEFERIWETQAKFHKELTPELKHIIRDIVIFYQRPLKSQKGLISLCELESREVEIEKDGKKVKKTIGPRVCPKSSPMYQEFRIWQQINNLQVSGMIVPDNRFDLFGETLDMKFGKRFLEQEEKEILFKELNFKSKLTKKEILRLLFKNYKELDLNYNEVKGNTTMAVLLEAYSKIIEMSGHGEYDFSKMTADEIKDFVFPIFNGLGFNTDILSFDSSVEGKAFEKQPSYMFWHLLYSYEGDKSKTGNESLINKISECYGFDKEYAAVIAGIRLEPDYGNLSVKAMRKILPYMKDGLGYSDACQYAGYRHSKRSLTKEEIDSRPLKNKVDLLPRNSLRNPIVEKILNQMINVVNAVVDVYGRPDEIRVEMARELKKTKAQREETVKTIRKVTVENEKYKKELEEEFGLKNVSRNDIIRYRLYLELKDNGFKTLYSNTYIPREKLFSKEFDIEHIIPQAKLFDDSLSNKTLEARNVNIEKADSTAYDYVKAKYGDEGLKKYNEKVKQLYEKKIIGKTKFKRLLTTEKDIPDGFINRDLSNTQYIARKACEILEEVARRVVSTTGSVTSRLREDWQLVDIMKELNWDKYDRLGLTEIVEDRDGRRIKHIKDWTKRNDQRHHAMDALTIAFTKPAFIQYLNNLNARSDKGGSIYTIERKELYRDNKGKLRFYPPMPLDEFRAEAKCHLENILVSIKAKNKVVTRNVNITKAKKAEKGKHERIQLTPRGQLHNETIYGRIKQYATKEEKVNASFTEDKIMTVACKRYREALIGRLRQYEGDSKKAFTGKNSLAKNPLFTDNQHTETVPEKVKTVMFTYIYTKREVISPDLKIDKVIDVGIKRLLQKRLEQYGGDMQKAFSNLDENPIWLNKEKRISIKSVTIIGVSNAEALHDKKDNRGQLILDKNGNKQPTDFVQTSGNHHVAIFRDSDGNLQEHMVSFYEATARAIQHLPIINREYNKDLGWQFLFTMKQNEYFVFPNEQTGFNPKEIDLLDPKNYALISPNLFRVQTMSKVMYGNNIVRDYKFRHHLETTVTRDLKDVTYKQYKNLSFANYIVKVRINHLGQIVSVGEY

SEQ ID NO: 7904 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNVTISAIFDAFKEIILQSGHDNNNFNKASFKDTMLIIKPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 7905 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERVKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSQKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY
